(12) United States Patent
Abbas et al.

(10) Patent No.: US 7,749,695 B2
(45) Date of Patent: Jul. 6, 2010

(54) PRO POLYPEPTIDES FOR DIAGNOSIS OF SYSTEMIC LUPUS ERYTHEMATOSIS

(76) Inventors: Alexander Abbas, 6087 Ocean View Dr., Oakland, CA (US) 94618; Sarah Bodary, 1951 Camino de los Robles, Menlo Park, CA (US) 94025; Hilary Clark, 1504 Noe St., San Francisco, CA (US) 94131; P Mickey Williams, 509 Alto Ave., Half Moon Bay, CA (US) 94019; Thomas D Wu, 41 Nevada St., San Francisco, CA (US) 94110

( * ) Notice: Subject to any disclaimer, the term of this patent is extended or adjusted under 35 U.S.C. 154(b) by 734 days.

(21) Appl. No.: 10/547,578

(22) PCT Filed: Mar. 2, 2004

(86) PCT No.: PCT/US2004/006460

§ 371 (c)(1), (2), (4) Date: Aug. 7, 2006

(87) PCT Pub. No.: WO2005/051988

PCT Pub. Date: Jun. 9, 2005

(65) Prior Publication Data

US 2009/0054300 A1    Feb. 26, 2009

Related U.S. Application Data

(60) Provisional application No. 60/451,884, filed on Mar. 3, 2003.

(51) Int. Cl.
C12Q 1/68 (2006.01)
G01N 33/53 (2006.01)
H01L 21/20 (2006.01)

(52) U.S. Cl. ............ 435/6; 435/7.1; 435/7.91; 436/501; 436/503; 436/504

(58) Field of Classification Search ............... None
See application file for complete search history.

(56) References Cited

U.S. PATENT DOCUMENTS 5,843,642 A * 12/1998 Dmitrovsky et al. ........... 435/6

FOREIGN PATENT DOCUMENTS

| WO | WO 01/75067 | 10/2001 |
|---|---|---|
| WO | WO 01/75166 A2 | 11/2001 |
| WO | WO 02/057454 | 7/2002 |
| WO | WO 2004/024072 | 3/2004 |

OTHER PUBLICATIONS

Crow, M.K., et al., *Arthritis Research and Therapy*—5(6):279-287 (2003).
Giguere, V., et al., *Nature*—330(6149):624-629 (1987).
Han, G-M., et al., *Genes and Immunity*- 4(3):177-186 (2003).
Russ, V., et al., *Clinical Immunology*—102(3):283-290 (2002).
Kohler and Milstein., "Continuous Cultures of Fused Cells Secreting Antibody of Predefined Specificity" *Nature* 256:495-497 (Aug. 1975).
Yamauchi, T., et al., *J. Pharmacol. Exp. Ther.*—312(3):938-944 (2005).

* cited by examiner

*Primary Examiner*—Olga N Chernyshev
(74) *Attorney, Agent, or Firm*—Craig G. Svoboda; Christopher De Vry; Ginger R. Dreger

(57) ABSTRACT

The present invention relates to compositions containing novel proteins and methods of using those compositions for the diagnosis and treatment of immune related diseases.

7 Claims, 661 Drawing Sheets

FIGURE 1

```
GCTCTGCTCCAGGCATCTGCCACAATGTGGGTGCTTACACCTGCTGCTTTTGCTGGGAAGCTCTTGAGTGTGTTC
AGGCAACCTCTGAGCTCTCTGTGGAGGAGCCTGGTCCCGCTGTTCTGCTGGCTGAGGGCAACCTTCTGGCTGCTA
GCTACCAAGAGGAGAAAGCAGCAGCTGGTCCTGAGAGGGCCAGATGAGACCAAAGAGGAGGAAGAGGACCCTCCT
CTGCCCACCACCCCAACCAGCGTCAACTATCACTTCACTCGCCAGTGCAACTACAAATGCGGCTTCTGTTTCCAC
ACAGCCAAAACATCCTTTGTGCTGCCCCTTGAGGAAGCAAAGAGAGGATTGCTTTTGCTTAAGGAAGCTGGTATG
GAGAAGATCAACTTTTCAGGTGGAGAGCCATTTCTTCAAGACCGGGGAGAATACCTGGGCAAGTTGGTGAGGTTC
TGCAAAGTAGAGTTGCGGCTGCCCAGCGTGAGCATCGTGAGCAATGGAAGCCTGATCCGGGAGAGGTGGTTCCAG
AATTATGGTGAGTATTTGGACATTCTCGCTATCTCCTGTGACAGCTTTGACGAGGAAGTCAATGTCCTTATTGGC
CGTGGCCAAGGAAAGAAGAACCATGTGGAAAACCTTCAAAAGCTGAGGAGGTGGTGTAGGGATTATAGAGTCGCT
TTCAAGATAAATTCTGTCATTAATCGTTTCAACGTGGAAGAGGACATGACGGAACAGATCAAAGCACTAAACCCT
GTCCGCTGGAAAGTGTTCCAGTGCCTCTTAATTGAGGGTGAGAATTGTGGAGAAGATGCTCTAAGAGAAGCAGAA
AGATTTGTTATTGGTGATGAAGAATTTGAAAGATTCTTGGAGCGCCACAAAGAAGTGTCCTGCTTGGTGCCTGAA
TCTAACCAGAAGATGAAAGACTCCTACCTTATTCTGGATGAATATATGCGCTTTCTGAACTGTAGAAAGGGACGG
AAGGACCCTTCCAAGTCCATCCTGGATGTTGGTGTAGAAGAAGCTATAAAATTCAGTGGATTTGATGAAAGATG
TTTCTGAAGCGAGGAGGAAAATACATATGGAGTAAGGCTGATCTGAAGCTGGATTGGTAGAGCGGAAAGTGGAAC
GAGACTTCAACACACCAGTGGGAAAACTCCTAGAGTAACTGCCATTGTCTGCAATACTATCCCGTTGGTATTTCC
CAGTGGCTGAAAACCTGATTTCTGCTGCACGTGGCATCTGATTACCTGTGGTCACTGAACACACGAATAACTTG
GATAGCAAATCCTGAGACAATGGAAAACCATTAACTTTACTTCATTGGCTTATAACCTTGTTGTTATTGAAACAG
CACTTCTGTTTTGAGTTTGTTTTAGCTAAAAAGAAGGAATACACACAGGAATAATGACCCCAAAAATGCTTAGA
TAAGGCCCCTATACACAGGACCTGACATTTAGCTCAATGATGCGTTTGTAAGAAATAAGCTCTAGTGATATCTGT
GGGGGCAAAATTTAATTTGGATTTGATTTTTAAAACAATGTTTACTGCGATTTCTATATTTCCATTTTGAAACT
ATTTCTTGTTCCAGGTTTGTTCATTTGACAGAGTCAGTATTTTTGCCAAATATCCAGATAACCAGTTTTCACAT
CTGAGACATTACAAAGTATCTGCCTCAATTATTTCTGCTGGTTATAATGCTTTTTTTTTTTGCCTTTATGCCAT
TGCAGTCTTGTACTTTTTACTGTGATGTACAGAAATAGTCAACAGATGTTTCCAAGAACATATGATATGATAATC
CTACCAATTTTCAAGAAGTCTCTAGAAAGAGATAACACATGGAAAGACGGCGTGGTGCAGCCCAGCCCACGGTGC
CTGTTCCATGAATGCTGGCTACCTATGTGTGTGGTACCTGTTGTGTCCCTTTCTCTTCAAAGATCCCTGAGCAAA
ACAAAGATACGCTTTCCATTTGATGATGGAGTTGACATGGAGGCAGTGCTTGCATTGCTTTGTTCGCCTATCATC
TGGCCACATGAGGCTGTCAAGCAAAAGAATAGGAGTGTAGTTGAGTAGCTGGTTGGCCCTACATTTCTGAGAAGT
GACGTTACACTGGGTTGGCATAAGATATCCTAAAATCACGCTGGAACCTTGGGCAAGGAAGAATGTGAGCAAGAG
TAGAGAGAGTGCCTGGATTTCATGTCAGTGAAGCCATGTCACCATATCATATTTTTGAATGAACTCTGAGTCAGT
TGAAATAGGGTACCATCTAGGTCAGTTTAAGAAGAGTCAGCTCAGAGAAAGCAAGCATAAGGGAAAATGTCACGT
AAACTAGATCAGGGAACAAAATCCTCTCCTTGTGGAAATATCCCATGCAGTTTGTTGATACAACTTAGTATCTTA
TTGCCTAAAAAAAATTTCTTATCATTGTTTCAAAAAAGCAAAATCATGGAAAATTTTTGTTGTCCAGGCAAATA
AAAGGTCATTTTAATTTAAAAAAAAAAAAAAAAAAAAAAAAAAAAAAAAAAGGCCAAGGAAAAAAAATATTCCTACT
TAAATTTTAAGTCTATAATTCAATTTAAATATGTGTGTGTCTCATCCAGGATAGGATAGGTTGTCTTCTATTTTC
CATTTTACCTATTTACTTTTTTTGTAAGAAAAGAGAAGAATGAATTCTAAAGATGTTCCCCATGGGTTTTGATTG
TGTCTAAGCTATGATGACCTTCATATAATCAGCATAAACATAAAACAAATTTTTTACTTAACATGAGTGCACTTT
ACTAATCCTCATGGCACAGTGGCTCACGCCTGTAATCCCAGCACTTGGGGAGGACAATGTGGGGTGGATCACGAG
GTC
```

FIGURE 2

MWVLTPAAFAGKLLSVFRQPLSSLWRSLVPLFCWLRATFWLLATKRRKQQLVLRGPDETKEEEEDPPLPTTPTSV
NYHFTRQCNYKCGFCFHTAKTSFVLPLEEAKRGLLLLKEAGMEKINFSGGEPFLQDRGEYLGKLVRFCKVELRLP
SVSIVSNGSLIRERWFQNYGEYLDILAISCDSFDEEVNVLIGRGQGKKNHVENLQKLRRWCRDYRVAFKINSVIN
RFNVEEDMTEQIKALNPVRWKVFQCLLIEGENCGEDALREAERFVIGDEEFERFLERHKEVSCLVPESNQKMKDS
YLILDEYMRFLNCRKGRKDPSKSILDVGVEEAIKFSGFDEKMFLKRGGKYIWSKADLKLDW

FIGURE 3

CAGGAAGGGCCATGAAGATTAATAAAGATTTGGACTCAGGGCAAATATTTACTTAGTAGCAATAACTCAAAGAAT
TACTGTTGAATAAATAAGCCAATTAAGCAGCCAATCACGTACTATGCGGATGCACACAAATGAAACCCTCACTTC
AACCTGAAGACATTCGCACATGAGTTACGTAGAGGGACCTGCAGGAAGCGGTAGAGAAAACATAAGGCTTATGCG
TTTAATTTCCACACCAATTTCAGGATCTTTGTCACTGACAGCAGCACTAAGACTTGTTAACTTTATATAGTTAAG
AAGAACAAGGCTGAGCGCGATGACTCACGCCTGTAAGCCTAGAACTTTGGGAGGCCAAAGCAGGCAGACTGCTTG
AGCCCAGGAGTTCCAGACCAGCCTGGGCAACATGGCAACACCCCATCTCTACAAAAAAATACAAGAATCAGCTGG
GCGTGGTGATGTGTTCCTGTAATCTCAGCTACTCGGGAGGCAGAGGCAGGAGGATTGCTTGAACCCGGGAGGCAG
AGGTTGTAGTTAGCCGAGATCTCGCCACTGCACTCCAGTCTGGACGACAGAGTGAGACTCAGTCTCAAATAAATA
AATAAATACATAAATATAAGGAAAAAAATAAAGCTGCTTTCTCCTCTTCCTCCTCTTTGGTCTCATCTGGCTCTG
CTCCAGGCATCTGCCACAATGTGGGTGCTTACACCTGCTGCTTTTGCTGGGAAGTTCTTGAGTGTGTTCAGGCAA
CCTCTGAGCTCTCTGTGGAGGAGCCTGGTCCCGCTGTTCTGCTGGCTGAGGGCAACCTTCTGGCTGCTAGCTACC
AAGAGGAGAAAGCAGCAGCTGGTCCTGAGAGGGCCAGATGAGACCAAAGAGGAGGAAGAGGACCCTCCTCTGCCC
ACCACCCCAACCAGCGTCAACTATCACTTCACTCGCCAGTGCAACTACAAATGCGGCTTCTGTTTCCACACAGCC
AAAACATCCTTTGTGCTGCCCCTTGAGGAAGCAAAGAGAGGATTGCTTTTGCTTAAGGAAGCTGGTATGGAGAAG
ATCAACTTTTCAGGTGGAGAGCCATTTCTTCAAGACCGGGGAGAATACCTGGGCAAGTTGGTGAGGTTCTGCAAA
GTAGAGTTGCGGCTGCCCAGCGTGAGCATCGTGAGCAATGGAAGCCTGATCCGGGAGAGGTGGTTCCAGAATTAT
GGTGAGTATTTGGACATTCTCGCTATCTCCTGTGACAGCTTTGACGAGGAAGTCAATGTCCTTATTGGCCGTGGC
CAAGGAAAGAAGAACCATGTGGAAAACCTTCAAAAGCTGAGGAGGTGGTGTAGGGATTATAGAATCCCTTTCAAG
ATAAATTCTGTCATTAATCGTTTCAACGTGGAAGAGGACATGACGGAACAGATCAAAGCACTAAACCCTGTCCGC
TGGAAAGTGTTCCAGTGCCTCTTAATTGAAGGTGAGAATTGTGGAGAAGATGCTCAAGAGAAGCAGAAAGATTT
GTTATTGGTGATGAAGAATTTGAAAGATTCTTGGAGCGCCACAAAGAAGTGTCCTGCTTGGTGCCTGAATCTAAC
CAGAAGATGAAAGACTCCTACCTTATTCTGGATGAATATATGCGCTTTCTGAACTGTAGAAAGGGACGGAAGGAC
CCTTCCAAGTCCATCCTGGATGTTGGTGTAGAAGAAGCTATAAAATTCAGTGGATTTGATGAAAAGATGTTTCTG
AAGCGAGGAGGAAAATACATATGGAGTAAGGCTGATCTGAAGCTGGATTGGTAGAGCGGAAAGTGGAACGAGACT
TCAACACACCAGTGGGAAAACTCCTAGAGTAACTGCCATTGTCTGCAATACTATCCCGTTGGTATTTCCCAGTGG
CTGAAAACCTGATTTTCTGCTGCACGTGGCATCTGATTACCTGTGGTCACTGAACACACGAATAACTTGGATAGC
AAATCCTGAGACAATGGAAAACCATTAACTTTACTTCATTGGCTTATAACCTTGTTGTTATTGAAACAGCACTTC
TGTTTTTGAGTTTGTTTTAGCTAAAAGAAGGAATACACACAGGAATAATGACCCCAAAAATGCTTAGATAAGGC
CCCTATACACAGGACCTGACATTTAGCTCAATGATGCGTTTGTAAGAAATAAGCTCTAGTGATATCTGTGGGGGC
AATATTTAATTTGGATTTGATTTTTAAAACAATGTTTACTGCGATTTCTATATTTCCATTTGAAACTATTTCT
TGTTCCAGGTTTGTTCATTTGACAGAGTCAGTATTTTTGCCAAATATCCAGATAACCAGTTTTCACATCTGAGA
CATTACAAAGTATCTGCCTCAATTATTTCTGCTGGTTATAATGCTTTTTTTTTTTTGCTTTATGCCATTGCA
GTCTTGTACTTTTTACTGTGATGTACAGAAATAGTCAACAGATGTTTCCAAGAACATATGATATGATAATCCTAC
CAATTTTCAAGAAGTCTCTAGAAAGAGATAACACATGGAAAGACGGCGTGGTGCAGCCCAGCCCACGGTGCCTGT
TCCATGAATGCTGGCTACCTATGTGTGTGGTACCTGTTGTGTCCCTTTCTCTTCAAAGATCCCTGAGCAAAACAA
AGATACGCTTTCCATTTGATGATGGAGTTGACATGGAGGCAGTGCTTGCATTGCTTTGTTCGCCTATCATCTGGC
CACATGAGGCTGTCAAGCAAAAGAATAGGAGTGTAGTTGAGTAGCTGGTTGGCCCTACATTTCTGAAGAGTGACG
TTACACTGGGTTGGCATAAGATATCCTAAAATCACGCTGGAACCTTGGGCAAGGAAGAATGTGAGCAAGAGTAGA
GAGAGTGCCTGGATTTCATGTCAGTGAAGCCATGTCACCATATCATATTTTGAATGAACTCTGAGTCAGTTGAA
ATAGGGTACCATCTAGGTCAGTTTAAGAAGAGTCAGCTCAGAGAAAGCAAGCATAAGGGAAAATGTCACGTAAAC
TAGATCAGGGAACAAAATCCTCTCCTTGTGGAAATATCCCATGCAGTTTGTTGATACAACTTAGTATCTTATTGC
CTAAAAAAAAATTTCTTATCATTGTTTCAAAAAAGCAAAATCATGGAAAATTTTTGTTGTCCAGGCAAATAAAAG
GTCATTTTAATTTAAAAAAAAAAAAAAAAAAAAAAAAAAAAAAAAAAGGCCA

FIGURE 4

MWVLTPAAFAGKFLSVFRQPLSSLWRSLVPLFCWLRATFWLLATKRRKQQLVLRGPDETKEEEEDPPLPTTPTSV
NYHFTRQCNYKCGFCFHTAKTSFVLPLEEAKRGLLLLKEAGMEKINFSGGEPFLQDRGEYLGKLVRFCKVELRLP
SVSIVSNGSLIRERWFQNYGEYLDILAISCDSFDEEVNVLIGRGQGKKNHVENLQKLRRWCRDYRIPFKINSVIN
RFNVEEDMTEQIKALNPVRWKVFQCLLIEGENCGEDALREAERFVIGDEEFERFLERHKEVSCLVPESNQKMKDS
YLILDEYMRFLNCRKGRKDPSKSILDVGVEEAIKFSGFDEKMFLKRGGKYIWSKADLKLDW

FIGURE 5

GCACGAGGAAGCCACAGATCTCTTAAGAACTTTCTGTCTCCAAACCGTGGCTGCTCGATAAATCAGACAGAACAG
TTAATCCTCAATTTAAGCCTGATCTAACCCCTAGAAACAGATATAGAACAATGGAAGTGACAACAAGATTGACAT
GGAATGATGAAAATCATCTGCGCAACTGCTTGGAAATGTTTCTTTGAGTCTTCTCTATAAGTCTAGTGTTCATGG
AGGTAGCATTGAAGATATGGTTGAAAGATGCAGCCGTCAGGGATGTACTATAACAATGGCTTACATTGATTACAA
TATGATTGTAGCCTTTATGCTTGGAAATTATATTAATTTACGTGAAAGTTCTACAGAGCCAAATGATTCCCTATG
GTTTTCACTTCAAAAGAAAAATGACACCACTGAAATAGAAACTTTACTCTTAAATACAGCACCAAAAATTATTGA
TGAGCAACTGGTGTGTCGTTTATCGAAAACGGATATTTTCATTATATGTCGAGATAATAAAATTTATCTAGATAA
AATGATAACAAGAAACTTGAAACTAAGGTTTTATGGCCACCGTCAGTATTTGGAATGTGAAGTTTTTCGAGTTGA
AGGAATTAAGGATAACCTAGACGACATAAAGAGGATAATTAAAGCCAGAGAGCACAGAAATAGGCTTCTAGCAGA
CATCAGAGACTATAGGCCCTATGCAGACTTGGTTTCAGAAATTCGTATTCTTTTGGTGGGTCCAGTTGGGTCTGG
AAAGTCCAGTTTTTTCAATTCAGTCAAGTCTATTTTTCATGGCCATGTGACTGGCCAAGCCGTAGTGGGGTCTGA
TACCACCAGCATAACCGAGCGGTATAGGATATATTCTGTTAAAGATGGAAAAAATGGAAAATCTCTGCCATTTAT
GTTGTGTGACACTATGGGGCTAGATGGGGCAGAAGGAGCAGGACTGTGCATGGATGACATTCCCCACATCTTAAA
AGGTTGTATGCCAGACAGATATCAGTTTAATTCCCGTAAACCAATTACACCTGAGCATTCTACTTTTATCACCTC
TCCATCTCTGAAGGACAGGATTCACTGTGTGGCTTATGTCTTAGACATCAACTCTATTGACAATCTCTACTCTAA
AATGTTGGCAAAAGTGAAGCAAGTTCACAAAGAAGTATTAAACTGTGGTATAGCATATGTGGCCTTGCTTACTAA
AGTGGATGATTGCAGTGAGGTTCTTCAAGACAACTTTTTAAACATGAGTAGATCTATGACTTCTCAAAGCCGGGT
CATGAATGTCCATAAAATGCTAGGCATTCCTATTTCCAATATTTTGATGGTTGGAAATTATGCTTCAGATTTGGA
ACTGGACCCCATGAAGGATATTCTCATCCTCTCTGCACTGAGGCAGATGCTGCGGGCTGCAGATGATTTTTAGA
AGATTTGCCTCTTGAGGAAACTGGTGCAATTGAGAGAGCGTTACAGCCCTGCATTTGAGATAAGTTGCCTTGATT
CTGACATTTGGCCCAGCCTGTACTGGTGTGCCGCAATGAGAGTCAATCTCTATTGACAGCCTGCTTCAGATTTTG
CTTTTGTTCGTTTTGCCTTCTGTCCTTGGAACAGTCATATCTCAAGTTCAAAGGCCAAAACCTGAGAAGCGGTGG
GCTAAGATAGGTCCTACTGCAAACCACCCCTCCATATTTCCGTACCATTTACAATTCAGTTTCTGTGACATCTTT
TTAAACCACTGGAGGAAAAATGAGATATTCTCTAATTTATTCTTCTATAACACTCTATATAGAGCTATGTGAGTA
CTAATCACATTGAATAATAGTTATAAAATTATTGTATAGACATCTGCTTCTTAAACAGATTGTGAGTTCTTTGAG
AAACAGCGTGGATTTTACTTATCTGTGTATTCACAGAGCTTAGCACAGTGCCTGGTAATGAGCAAGCATACTTGC
CATTACTTTTCCTTCCCACTCTCTCCAACATCACATTCACTTTAAATTTTTCTGTATATAGAAAGGAAAACTAGC
CTGGGCAACATGATGAAACCCCATCTCCACTGC

FIGURE 6

MVERCSRQGCTITMAYIDYNMIVAFMLGNYINLRESSTEPNDSLWFSLQKKNDTTEIETLLLNTAPKIIDEQLVC
RLSKTDIFIICRDNKIYLDKMITRNLKLRFYGHRQYLECEVFRVEGIKDNLDDIKRIIKAREHRNRLLADIRDYR
PYADLVSEIRILLVGPVGSGKSSFFNSVKSIFHGHVTGQAVVGSDTTSITERYRIYSVKDGKNGKSLPFMLCDTM
GLDGAEGAGLCMDDIPHILKGCMPDRYQFNSRKPITPEHSTFITSPSLKDRIHCVAYVLDINSIDNLYSKMLAKV
KQVHKEVLNCGIAYVALLTKVDDCSEVLQDNFLNMSRSMTSQSRVMNVHKMLGIPISNILMVGNYASDLELDPMK
DILILSALRQMLRAADDFLEDLPLEETGAIERALQPCI

FIGURE 7

```
CTTTTATTACAGTTAAATGGTTCCAGATGTAACCACTAGTTTTAAAGGTATTTGCTCATTGGTCTGGCTTAGAGA
CAGGAAGACATATGAGCCATAAAAAAAAGATTCTTTTGCATTTACCCATTTAGTAAAAACTTATTAAAACTGAAT
AAAGTGCTGTTCTTAAGTGCTTGAAAGACGTAAACCCAAGTGCACTTTATCTCATTTATCTTATGGTGGAAACAC
AGGAACCAATTCTCTAAGAGACTGTGTTTCTTTAGTTGAGAAGAAACTTCATTGAGTAGCTGTGATATGTTCGAT
ACTAAGGAAAAACTAAACAGATCACCTTTGACATGCGTTGTAGAGTGGGAATAAGAGAGGGCTTTTTATTTTTC
GTTCATACGAGTATTGATGAAGATGATACTAAATGCTAAATGAAATATATCTGCTCCAAAAGGCATTTATTCTGA
CTTGGAGATGCAACAAAAACACAAAAATGGAATGAAGTGATACTCTTCATCAAACAGAAGTGACTGTTATCTCAA
CCATTTTGTTAAATCCTAAACAGAAAACAAAAAAAATCATGACGAAAGACACTTGCTTATTAATTGGCTTGGAA
AGTAGAATATAGGAGAAAGGTTACTGTTTATTTTTTTCATGTATTCATTCATTCTACAAATATATTCGGGTGCC
AATAGGTACTTGGTATAAGGTTTTTGGCCCCAGAGACATGGGAAAAAATGCATGCCTTCCCAGAGAATGCCTAA
TACTTCCTTTTGGCTTGTTTCTTGTTAGGGCATGGCTTAGTCCCTAAATAACATTGTGTGGTTTAATTCCTA
CTCCGTATCTCTTCTACCACTCTGGCCACTACGATAAGCAGGTAGCTGGGTTTGTAGTGAGCTTGCTCCTTAAG
TTACAGGAACTCTCCTTATAATAGACACTTCATTTTCCTAGTCCATCCCTCATGAAAAATGACTGACCACTGCTG
GGCAGCAGGAGGGATGATGACCAACTAATTCCCAAACCCCAGTCTCATTGGTACCAGCCTTGGGGAACCACCTAC
ACTTGAGCCACAATTGGTTTTGAAGTGCATTTACAAGGTTTGTCTATTTTCAGTTCTTTACTTTTTACATGCTGA
CACATACATACACTGCCTAAATAGATCTCTTTCAGAAACAATCCTCAGATAACGCATAGCAAAATGGAGATGGAG
ACATGATTTCTCATGCAACAGCTTCTCTAATTATACCTTAGAAATGTTCTCCTTTTATCATCAAATCTGCTCAA
GAAGGGCTTTTTATAGTAGAATAATATCAGTGGATGAAAACAGCTTAACATTTTACCATGCTTAAGTTTTAAGAA
TAAAATAAAAATTGGAAATAATTGGCCAAAATTGAAAGGAAAAATTTTTTAAAATTTCTCTAAATGTAGGCCTG
GCTGGGCTTTGACCTTTTCCGTTTTAAATCACTCACAGAGGGTGGGACAGGAGGAAGAGTGAAGGAAAAGGTCA
AACCTGTTTTAAGGGCAACCTGCCTTTGTTCTGAATTGGTCTTAAGAACATTACCAGCTCCAGGTTTAAATTGTT
CAGTTCATGCAGTTCCAATAGCTGATCATTGTTGAGATGAGGACAAAATCCTTTGTCCTCACTAGTTGCTTTA
CATTTTTGAAAAGTATTATTTTTGTCCAAGTGCTTATCAACTAAACCTTGTGTTAGGTAAGAATGGAATTTATTA
AGTGAATCAGTGTGACCCTTCTTGTCATAAGATTATCTTAAAGCTGAAGCCAAAATATGCTTCAAAAGAAGAGGA
CTTTATTGTTCATTGTAGTTCATACATTCAAAGCATCTGAACTGTAGTTTCTATAGCAAGCCAATTACATCCATA
AGTGGAGAAGGAAATAGATAAATGTCAAAGTATGATTGGTGGAGGGAGCAAGGTTGAAGATAATCTGGGGTTGAA
ATTTTCTAGTTTTCATTCTGTACATTTTTAGTTAGACATCAGATTTGAAATATTAATGTTTACCTTTCAATGTGT
GGTATCAGCTGGACTCAGTAACACCCCTTCTTCAGCTGGGGATGGGGAATGGATTATTGGAAAATGGAAAGAAG
AAAGTAACTAAAAGCCTTCCTTTCACAGTTTCTGGCATCACTACCACTACTGATTAAACAAGAATAAGAGAACAT
TTTATCATCATCTGCTTTATTCACATAAATGAAGTTGTGATGAATAAATCTGCTTTTATGCAGACACAAGGAATT
AAGTGGCTTCGTCATTGTCCTTCTACCTCAAAGATAATTTATTCCAAAAGCTAAGATAAATGGAAGACTCTTGAA
CTTGTGAACTGATGTGAAATGCAGAATCTCTTTTGAGTCTTTGCTGTTTGGAAGATTGAAAAATATTGTTCAGCA
TGGGTGACCACCAGAAAGTAATCTTAAGCCATCTAGATGTCACAATTGAAACAAACTGGGGAGTTGGTTGCTATT
GTAAAATAAAATATACTGTTTTG
```

FIGURE 8

MGDHQKVILSHLDVTIETNWGVGCYCKIKYTV

FIGURE 9

```
AATAGATAACTACTATAGTGGCCAATCTCATTGCTAGGCATTGGGGATGCAAAGATAAACCATCTTTATTGTGTC
TTGGGTAGCAGAAGAAAATATGTGTAAAATCAATTTATAATTTGTAAACTGCCACCCATATATAAGCTATATCTG
CTGAATGATCATTGATTACTCTTATCCTTAGAGATAACAACTGGGGGCACAAACATTTATTATCATTATTGAACC
TACAACAGAGATCTATGTGTAGATTTACAAAGCCTACAGTTCTATACAGATAGGAATGAACTATTGGCTTACTGA
ATGGTGATTACTTTCTGTGGGGCTCGGAACTACATGCCCTAGGATATAAAAATGATGTTATCATTATAGAGTGCT
CACACAGAAGGAAATGAAGTAATATAGGTGTGAGATCCAGACCAAAAGTCATTTAACAAGTTTATTCAGTGATGAAA
ACATGGGACAAATGGACTAATATAAGGCAGTGTACTAAGCTGAGTAGAGAGATAAAGTCCTGTCCAGAAGATACA
TGCTTCCTGGCCTGATTGAGGAGATGGAAAATTTTTGCAAAAAACAAGGTGTTGTGGTCTTCCATCCAGTTTCTT
AAGTGCTGATGATAAAAGTGAATTAGACCCACCTTGACCTGGCCTACAGAAGTAAAGGAGTAAAAATAAATGCCT
CAGGCGTGCTTTTTGATTCATTTGATAAACAAAGCATCTTTTATGTGGAATATACCATTCTGGGTCCTGAGGATA
AGAGAGATGAGGGCATTAGATCACTGACAGCTGAAGATAGAAGAACATCTTTGGTTTGATTGTTTAAATAATATT
TCAATGCCTATTCTCTGCAAGGTACTATGTTTCGTAAATTAAATAGGTCTGGCCCAGAAGACCCACTCAATTGCC
TTTGAGATTAAAAAAAACAAAAAAAGAAAGAAAAATGCAAGTTTCTTTCAAAATAAAGAGACATTTTTCCTAGTT
TCAGGAATCCCCCAAATCACTTCCTCATTGGCTTAGTTTAAAGCCAGGAGACTGATAAAAGGGCTCAGGGTTTGT
TCTTTAATTCATTAACTAAACATTCTGCTTTTATTACAGTTAAATGGTTCAAGATGTAACAACTAGTTTTAAAGG
TATTGCTCATTGGTCTGGCTTAGAGACAGGAAGACATATGAGCAATAAAAAAAAGATTCTTTTGCATTTACCAA
TTTAGTAAAAATTTATTAAAACTGAATAAAGTGCTGTTCTTAAGTGCTTGAAAGACGTAAACCAAAGTGCACTTT
ATCTCATTTATCTTATGGTGGAAACACAGGAACAAATTCTCTAAGAGACTGTGTTTCTTTAGTTGAGAAGAAACT
TCATTGAGTAGCTGTGATATGTTCGATACTAAGGAAAAACTAAACAGATCACCTTTGACATGCGTTGTAGAGTGG
GAATAAGAGAGGGCTTTTTATTTTTTCGTTCATACGAGTATTGATGAAGATGATACTAAATGCTAAATGAAATAT
ATCTGCTCCAAAAGGCATTTATTCTGACTTGGAGATGCAACAAAAACACAAAAATGGAATGAAGTGATACTCTTC
ATCAAACAGAAGTGACTGTTATCTCAACCATTTTGTTAAATCCTAAACAGAAAACAAAAAAAATCATGACGAAAA
GACACTTGCTTATTAATTGGCTTGGAAAGTAGAATATAGGAGAAAGGTTACTGTTTATTTTTTTCATGTATTCA
TTCATTCTACAAATATATTCGGGTGCCAATAGGTACTTGGTATAAGGTTTTTGGCCCCAGAGACATGGGAAAAAA
ATGCATGCCTTCCCAGAGAATGCCTAATACTTTCCTTTTGGCTTGTTTTCTTGTTAGGGGCATGGCTTAGTCCCT
AAATAACATTGTGTGGTTTAATTCCTACTCCGTATCTCTTCTACCACTCTGGCCACTACGATAAGCAGGTAGCTG
GGTTTTGTAGTGAGCTTGCTCCTTAAGTTACAGGAACTCTCCTTATAATAGACACTTCATTTTCCTAGTCCATCC
CTCATGAAAAATGACTGACCACTGCTGGAAGAAAACAGAAATGTTTCAACGTGCGCAAGAGTTGCGGCGGCGAG
CAGAGGACTACCACAAATGCAAATCCCCCCTTCTGCAAGAAAGGCTCTTTGCAACTGGGTCAGAATGGCGGCAG
CGGAGCATCGTCATTCTTCAGGATTGCCCTACTGGCCCTACCTCACAGCTGAAACTTTAAAAAACAGGATGGGCC
ACCAGCCACCTCCTCCAACTCAACAACATTCTATAACTGATAACTCCCTGAGCCTCAAGACACCTCCCGAGTGTC
TGCTCACTCCCCTTCCACCCTCAGCGGATGATAATCTCAAGACACCTCCCGAGTGTGTGCTCACTCCCCTTCCAC
CCTCAGCGGATGATAATCTCAAGACACCTCCCGAGTGTGTGGTCACTCCCCTTCCACCCTCAGCGGATGATAATC
TCAAGACACCTCCTGAGTGTCTGCTCACTCCCCTTCCACCCTCAGCGGATGATAATCTCAAGACACCTCCCGAGT
GTCTACTCACTCCCCG
```

FIGURE 10

MFQRAQELRRRAEDYHKCKIPPSARKALCNWVRMAAAEHRHSSGLPYWPYLTAETLKNRMGHQPPPPTQQHSITD
NSLSLKTPPECLLTPLPPSADDNLKTPPECVLTPLPPSADDNLKTPPECVVTPLPPSADDNLKTPPECLLTPLPP
SADDNLKTPPECLLTP

FIGURE 11A

ATGGGCTTCTTGCCCAAGCTTCTCCTCCTGGCCTCATTCTTCCCAGCAGGCCAGGCCTCATGGGGCGTCTCCAGT
CCCCAGGACGTGCAGGGTGTGAAGGGGTCTTGCCTGCTTATCCCCTGCATCTTCAGCTTCCCTGCCGACGTGGAG
GTGCCCGACGGCATCACGGCCATCTGGTACTACGACTACTCGGGCCAGCGGCAGGTGGTGAGCCACTCGGCGGAC
CCCAAGCTGGTGGAGGCCCGCTTCCGCGGCCGCACCGAGTTCATGGGGAACCCCGAGCACAGGGTGTGCAACCTG
CTGCTGAAGGACCTGCAGCCCGAGGACTCTGGTTCCTACAACTTCCGCTTCGAGATCAGTGAGGTCAACCGCTGG
TCAGATGTGAAAGGCACCTTGGTCACAGTAACAGAGGAGCCCAGGGTGCCCACCATTGCCTCCCCGGTGGAGCTT
CTCGAGGGCACAGAGGTGGACTTCAACTGCTCCACTCCCTACGTATGCCTGCAGGAGCAGGTCAGACTGCAGTGG
CAAGGCCAGGACCCTGCTCGCTCTGTCACCTTCAACAGCCAGAAGTTTGAGCCCACCGGCGTCGGCCACCTGGAG
ACCCTCCACATGGCCATGTCCTGGCAGGACCACGGCCGGATCCTGCGCTGCCAGCTCTCCGTGGCCAATCACAGG
GCTCAGAGCGAGATTCACCTCCAAGTGAAGTATGCCCCCAAGGGTGTGAAGATCCTCCTCAGCCCCTCGGGGAGG
AACATCCTTCCAGGTGAGCTGGTCACACTCACCTGCCAGGTGAACAGCAGCTACCCTGCAGTCAGTTCCATTAAG
TGGCTCAAGGATGGGGTACGCCTCCAAACCAAGACTGGTGTGCTGCACCTGCCCCAGGCAGCCTGGAGCGATGCT
GGCGTCTACACCTGCCAAGCTGAGAACGGCGTGGGCTCTTTGGTCTCACCCCCATCAGCCTCCACATCTTCATG
GCTGAGGTCCAGGTGAGCCCAGCAGGTCCCATCCTGGAGAACCAGACAGTGACACTAGTCTGCAACACACCCAAT
GAGGCACCCAGTGATCTCCGCTACAGCTGGTACAAGAACCATGTCCTGCTGGAGGATGCCCACTCCCATACCCTC
CGGCTGCACTTGGCCACTAGGGCTGATACTGGCTTCTACTTCTGTGAGGTGCAGAACGTCCATGGCAGCGAGCGC
TCGGGCCCTGTCAGCGTGGTAGTCAACCACCCGCCTCTCACTCCAGTCCTGACAGCCTTCCTGGAGACCCAGGCG
GGACTTGTGGGCATCCTTCACTGCTCTGTGGTCAGTGAGCCCCTGGCCACACTGGTGCTGTCACATGGGGGTCAT
ATCCTGGCCTCCACCTCCGGGGACAGTGATCACAGCCCACGCTTCAGTGGTACCTCTGGTCCCAACTCCCTGCGC
CTGGAGATCCGAGACCTGGAGGAAACTGACAGTGGGGAGTACAAGTGCTCAGCCACCAACTCCCTTGGAAATGCA
ACCTCCACCCTGGACTTCCATGCCAATGCCGCCCGTCTCCTCATCAGCCCGGCAGCCGAGGTGGTGGAAGGACAG
GCAGTGACACTGAGCTGCAGAAGCGGCCTAAGCCCCACACCTGATGCCCGCTTCTCCTGGTACCTGAATGGAGCC
CTGCTTCACGAGGGTCCCGGCAGCAGCCTCCTGCTCCCCGCGGCCTCCAGCACTGACGCCGGCTCATACCACTGC
CGGGCCCGGGACGGCCACAGTGCCAGTGGCCCCTCTTCGCCAGCTGTTCTCACTGTGCTCTACCCCCTCGACAA
CCAACATTCACCACCAGGCTGGACCTTGATGCCGCTGGGCCGGGGCTGGACGGCGAGGCCTCCTTTTGTGCCGT
GTGGACAGCGACCCCCCGCCAGGCTGCAGCTGCTCCACAAGGACCGTGTTGTGGCCACTTCCCTGCCATCAGGG
GGTGGCTGCAGCACCTGTGGGGGCTGTTCCCCACGCATGAAGGTCACCAAAGCCCCCAACTTGCTGCGTGTGGAG
ATTCACAACCCTTTGCTGGAAGAGGAGGGCTTGTACCTCTGTGAGGCCAGCAATGCCCTGGGCAACGCCTCCACC
TCAGCCACCTTCAATGGCCAGGCCACTGTCCTGGCCATTGCACCATCACACACACTTCAGGAGGGCACAGAAGCC
AACTTGACTTGCAACGTGAGCCGGGAAGCTGCTGGCAGCCCTGCTAACTTCTCCTGGTTCCGAAATGGGGTGCTG
TGGGCCCAGGGTCCCCTGGAGACCGTGACACTGCTGCCCGTGGCCAGAACTGATGCTGCCCTTTACGCCTGCCGC
ATCCTGACTGAGGCTGGTGCCCAGCTCTCCACTCCCGTGCTCCTGAGTGTACTCTATCCCCGGACCGTCCAAAG
CTGTCAGCCCTCCTAGACATGGGCCAGGGCCACATGGCTCTGTTCATCTGCACTGTGGACAGCCGCCCCTGGCC
TTGCTGGCCTTGTTCCATGGGGAGCACCTCCTGGCCACCAGCCTGGGTCCCCAGGTCCCATCCCATGGTCGGTTC
CAGGCTAAAGCTGAGGCCAACTCCCTGAAGTTAGAGGTCCGAGAACTGGGCCTTGGGGACTCTGGCAGCTACCGC
TGTGAGGCCACAAATGTTCTTGGATCATCCAACACCTCACTCTTCTTCCAGGTCCGAGGAGCCTGGGTCCAGGT
TCACCATCACCTGAGCTCCAAGAGGGCCAGGCTGTGGTCCTGAGCTGCCAGGTACACACAGGAGTCCCAGAGGGG
ACCTCATATCGTTGGTATCGGGATGGCCAGCCCCTCCAGGAGTCGACCTCGGCCACGCTCCGCTTTGCAGCCATA
ACTTTGACACAAGCTGGGGCCTATCATTGCCAAGCCCAGGCCCCAGGCTCAGCCACCACGAGCCTAGCTGCACCC
ATCAGCCTCCACGTGTCCTATGCCCCACGCCACGTCACACTCACTACCCTGATGGACACAGGCCCTGGACGACTG
GGCCTCCTCCTGTGCCGTGTGGACAGTGACCCTCCGGCCCAGCTGCGGCTGCTCCACGGGATCGCCTTGTGGCC
TCCACCCTACAAGGTGTGGGGGACCCGAAGGCAGCTCTCCCAGGCTGCATGTGGCTGTGGCCCCCAACACACTG
CGTCTGGAGATCCACGGGGCTATGCTGGAGGATGAGGGTGTCTATATCTGTGAGGCCTCCAACACCCTGGGCCAG
GCCTCGGCCTCAGCTGACTTCGACGCTCAAGCTGTGAATGTGCAGGTGTGGCCCGGGGCTACCGTGCGGGAGGGG
CAGCTGGTGAACCTGACCTGCCTTGTGTGGACCACTCACCCGGCCCAGCTCACCTACACATGGTACCAGGATGGG
CAGCAGCGCCTGGATGCCCACTCCATCCCCCTGCCCAACGTCACAGTCAGGGATGCCACCTCCTACCGCTGCGGT
GTGGGCCCCCTGGTCGGGCACCCCGCCTCTCCAGACCTATCACCTTGGACGTCCTCTACGCGCCCCGCAACCTG
CGCCTGACCTACCTCCTGGAGAGCCATGGCGGGCAGCTGGCCCTGGTACTGTGCACTGTGGACAGCCGCCCGCCC

FIGURE 11B

```
GCCCAGCTGGCCCTCAGCCACGCCGGTCGCCTCTTGGCCTCCTCGACAGCAGCCTCTGTCCCCAACACCCTGCGC
CTGGAGCTGCGAGGGCCACAGCCCAGGGATGAGGGTTTCTACAGCTGCTCTGCCCGCAGCCCTCTGGGCCAGGCC
AACACGTCCCTGGAGCTGCGGCTGGAGGGTGTGCGGGTGATCCTGGCTCCGGAGGCTGCCGTGCCTGAAGGTGCC
CCCATCACAGTGACCTGTGCGGACCCTGCTGCCCACGCACCCACACTCTATACTTGGTACCACAACGGTCGTTGG
CTGCAGGAGGGTCCAGCTGCCTCACTCTCATTCCTGGTGGCCACGCGGGCTCATGCAGGCGCCTACTCTTGCCAG
GCCCAGGATGCCCAGGGCACCCGCAGCTCCCGTCCTGCTGCCCTGCAAGTCCTCTATGCCCCTCAGGACGCTGTC
CTGTCCTCCTTCCGGGACTCCAGGGCCAGATCCATGGCTGTGATACAGTGCACTGTGGACAGTGAGCCACCTGCT
GAGCTGGCCCTATCTCATGATGGCAAGGTGCTGGCCACGAGCAGCGGGGTCCACAGCTTGGCATCAGGGACAGGC
CATGTCCAGGTGGCCCGAAACGCCCTACGGCTGCAGGTGCAAGATGTGCCTGCAGGTGATGACACCTATGTTTGC
ACAGCCCAAAACTTGCTGGGCTCAATCAGCACCATCGGGCGGTTGCAGGTAGAAGGTGCACGCGTGGTGGCAGAG
CCTGGCCTGGACGTGCCTGAGGGCGCTGCCCTGAACCTCAGCTGCCGCCTCCTGGGTGGCCCTGGGCCTGTGGGC
AACTCCACCTTTGCATGGTTCTGGAATGACCGGCGGCTGCACGCGGAGCCTGTGCCCACTCTCGCCTTCACCCAC
GTGGCTCGTGCTCAAGCTGGGATGTACCACTGCCTGGCTGAGCTCCCCACTGGGGCTGCTGCCTCTGCTCCAGTC
ATGCTCCGTGTGCTCTACCCTCCCAAGACGCCCACCATGATGGTCTTCGTGGAGCCTGAGGGTGGCCTCCGGGGC
ATCCTGGATTGCCGAGTGGACAGCGAGCCGCTCGCCAGCCTGACTCTCCACCTTGGCAGTCGACTGGTGGCCTCC
AGTCAGCCCCAGGGTGCTCCTGCAGAGCCACACATCCATGTCCTGGCTTCCCCCAATGCCCTGAGGGTGGACATC
GAGGCGCTGAGGCCCAGCGACCAAGGGGAATACATCTGTTCTGCCTCAAATGTCCTGGGCTCTGCCTCTACCTCC
ACCTACTTTGGGGTCAGAGCCCTGCACCGCCTGCATCAGTTCCAGCAGCTGCTCTGGGTCCTGGGACTGCTGGTG
GGCCTCCTGCTCCTGCTGTTGGGCCTGGGGGCCTGCTACACCTGGAGAAGGAGGCGTGTTTGTAAGCAGAGCATG
GGCGAGAATTCGGTGGAGATGGCTTTTCAGAAAGAGACCACGCAGCTCATTGATCCTGATGCAGCCACATGTGAG
ACCTCAACCTGTGCCCCACCCCTGGGCTGA
```

FIGURE 12

MGFLPKLLLLASFFPAGQASWGVSSPQDVQGVKGSCLLIPCIFSFPADVEVPDGITAIWYYDYSGQRQVVSHSAD
PKLVEARFRGRTEFMGNPEHRVCNLLLKDLQPEDSGSYNFRFEISEVNRWSDVKGTLVTVTEEPRVPTIASPVEL
LEGTEVDFNCSTPYVCLQEQVRLQWQGQDPARSVTFNSQKFEPTGVGHLETLHMAMSWQDHGRILRCQLSVANHR
AQSEIHLQVKYAPKGVKILLSPSGRNILPGELVTLTCQVNSSYPAVSSIKWLKDGVRLQTKTGVLHLPQAAWSDA
GVYTCQAENGVGSLVSPPISLHIFMAEVQVSPAGPILENQTVTLVCNTPNEAPSDLRYSWYKNHVLLEDAHSHTL
RLHLATRADTGFYFCEVQNVHGSERSGPVSVVVNHPPLTPVLTAFLETQAGLVGILHCSVVSEPLATLVLSHGGH
ILASTSGDSDHSPRFSGTSGPNSLRLEIRDLEETDSGEYKCSATNSLGNATSTLDFHANAARLLISPAAEVVEGQ
AVTLSCRSGLSPTPDARFSWYLNGALLHEGPGSSLLLPAASSTDAGSYHCRARDGHSASGPSSPAVLTVLYPPRQ
PTFTTRLDLDAAGAGAGRRGLLLCRVDSDPPARLQLLHKDRVVATSLPSGGGCSTCGGCSPRMKVTKAPNLLRVE
IHNPLLEEEGLYLCEASNALGNASTSATFNGQATVLAIAPSHTLQEGTEANLTCNVSREAAGSPANFSWFRNGVL
WAQGPLETVTLLPVARTDAALYACRILTEAGAQLSTPVLLSVLYPPDRPKLSALLDMGQGHMALFICTVDSRPLA
LLALFHGEHLLATSLGPQVPSHGRFQAKAEANSLKLEVRELGLGDSGSYRCEATNVLGSSNTSLFFQVRGAWVQV
SPSPELQEGQAVVLSCQVHTGVPEGTSYRWYRDGQPLQESTSATLRFAAITLTQAGAYHCQAQAPGSATTSLAAP
ISLHVSYAPRHVTLTTLMDTGPGRLGLLLCRVDSDPPAQLRLLHGDRLVASTLQGVGGPEGSSPRLHVAVAPNTL
RLEIHGAMLEDEGVYICEASNTLGQASASADFDAQAVNVQVWPGATVREGQLVNLTCLVWTTHPAQLTYTWYQDG
QQRLDAHSIPLPNVTVRDATSYRCGVGPPGRAPRLSRPITLDVLYAPRNLRLTYLLESHGGQLALVLCTVDSRPP
AQLALSHAGRLLASSTAASVPNTLRLELRGFQPRDEGFYSCSARSPLGQANTSLELRLEGVRVILAPEAAVPEGA
PITVTCADPAAHAPTLYTWYHNGRWLQEGPAASLSFLVATRAHAGAYSCQAQDAQGTRSSRPAALQVLYAPQDAV
LSSFRDSRARSMAVIQCTVDSEPPAELALSHDGKVLATSSGVHSLASGTGHVQVARNALRLQVQDVPAGDDTYVC
TAQNLLGSISTIGRLQVEGARVVAEPGLDVPEGAALNLSCRLLGGPGPVGNSTFAWFWNDRRLHAEPVPTLAFTH
VARAQAGMYHCLAELPTGAAASAPVMLRVLYPPKTPTMMVFVEPEGGLRGILDCRVDSEPLASLTLHLGSRLVAS
SQPQGAPAEPHIHVLASPNALRVDIEALRPSDQGEYICSASNVLGSASTSTYFGVRALHRLHQFQQLLWVLGLLV
GLLLLLLGLGACYTWRRRRVCKQSMGENSVEMAFQKETTQLIDPDAATCETSTCAPPLG

FIGURE 13

```
GAGAAGACCAGGGAAGAAGCAGAACTTGAGGCCAACAGTGTGTTTCGTCAAAAGGTAGAAATGTCCTACCAGCGG
ATGGAGAATCCTGGCTGCCATGTGGTTGATGCCAGCCCCTCCAGAGAAAAGGTCCTGCAGACGGTATTAAGCCTA
ATCCAGAATAGTTTTAGTGAACCGTAGTTACTCTGGCCAGGTGCCACGTCTAACTAGATTAGATGTTGTTTGAAA
CATCTACATCCACCATTTGTTATGCAGTGTTCCCAAATTTCTGTTCTACAAGCATGTTGTGTGGCAGAAAACTGG
AGACCAGGCATCTTAATTTTACTTCAGCCATCGTACCCTCTTCTGACTGATGGACCCGTCATCACAAAGGTCCCT
CTCATCATGTTCCAGTGAGAGGCCAGCGATTGCTTTCTTCCTGGCATAGTAAACATTTTCTTGGAACATATGTTT
CACTTAATCACTACCAAATATCTGGAAGACCTGTCTTACTCAGACAGCACCAGGTGTACAGAAGCAGCAGACAAG
ATCTTCCAGATCAGCAGGGAGACCCCGGAGCCTCTGCTTCTCCTACACTGGCATGCTGATGAGATCGTGACATGC
CCACATTGGCTTCTTCCACATCTGGTTGCACTCGTCATGATGGGCTCGCTGCATCTCCCTCAGTCCCAAATTCTA
GAGCCAAGTGTTCCTGCAGAGGCTGTCTATGTGTCCTGGCTGCCCAAGGACACTCCTGCAGAGCCATTTTTGGGT
AAGGAACACTTACAAAGAAGGCATTGATCTTGTGTCTGAGGCTCAGAGCCCTTTTGATAGGCTTCTGAGTCATAT
ATAAAGACATTCAAGCCAAGATGCTCCAACTGCAAATATACCAACCTTCTCTGAATTATATTTTGCTTATTTATA
TTTCTTTTCTTTTTTTCTAAAGTATGGCTCTGAATAGAATGCACATTTTCCATTGAACTGGATGCATTTCATTTA
GCCAATCCAGTAATTTATTTATATTAATCTATACATAATATGTTTCCTCAGCATAGGAGCTATGATTCATTAATT
AAAAGTGGAGTCAAAACGCTAAATGCAATGTTTGTTGTGTATTTTCATTACACAAACTTAATTTGTCTTGTTAAA
TAAGTACAGTGGATCTTGGAGTGGGATTTCTTGGTAAATTATCTTGCACTTGAATGTCTCATGATTACATATGAA
ATCGCTTTGACATATCTTTAGACAGAAAAAAGTAGCTGAGTGAGGGGGAAATTATAGAGCTGTGTGACTTTAGGG
AGTAGGTTGAACCAGGTGATTACCTAAAATTCCTTCCAGTTCAAAGGCAGATAAATCTGTAAATTATTTTATCCT
ATCTACCATTTCTTAAGAAGACATTACTCCAAAATAATTAAATTTAAGGCTTTATCAGGTCTGCATATAGAATCT
TAAATTCTAATAAAGTTTCATGTTAATGTCATAGGATTTTTAAAAGAGCTATAGGTAATTTCTGTATAATATGTG
TATATTAAAATGTAATTGATTTCAGTTGAAAGTATTTTAAAGCTGATAAATAGCATTAGGGTTCTTTGCAATGTG
GTATCTAGCTGTATTATTGGTTTTATTTACTTTAAACATTTTGAAAAGCTTATACTGGCAGCCTAGAAAAACAAA
CAATTAATGTATCTTTATGTCCCTGGCACATGAATAAACTTTGCTGTGGTTTACTAAAAAAAAAAAAAAAA
```

FIGURE 14

CGGCTGAGAGGCAGCGAACTCATCTTTGCCAGTACAGGAGCTTGTGCCGTGGCCCACAGCCCACAGCCCACAGCC
ATGGGCTGGGACCTGACGGTGAAGATGCTGGCGGGCAACGAATTCCAGGTGTCCCTGAGCAGCTCCATGTCGGTG
TCAGAGCTGAAGGCGCAGATCACCCAGAAGATTGGCGTGCACGCCTTCCAGCAGCGTCTGGCTGTCCACCCGAGC
GGTGTGGCGCTGCAGGACAGGGTCCCCCTTGCCAGCCAGGGCCTGGGCCCTGGCAGCACGGTCCTGCTGGTGGTG
GACAAATGCGACGAACCTCTGAGCATCCTGGTGAGGAATAACAAGGGCCGCAGCAGCACCTACGAGGTCCGGCTG
ACGCAGACCGTGGCCCACCTGAAGCAGCAAGTGAGCGGGCTGGAGGGTGTGCAGGACGACCTGTTCTGGCTGACC
TTCGAGGGGAAGCCCCTGGAGGACCAGCTCCCGCTGGGGGAGTACGGCCTCAAGCCCCTGAGCACCGTGTTCATG
AATCTGCGCCTGCGGGGAGGCGGCACAGAGCCTGGCGGGCGGAGCTAAGGGCCTCCACCAGCATCCGAGCAGGAT
CAAGGGCCGGAAATAAAGGCTGTTGTAAGAGAAT

FIGURE 15

MGWDLTVKMLAGNEFQVSLSSSMSVSELKAQITQKIGVHAFQQRLAVHPSGVALQDRVPLASQGLGPGSTVLLVV
DKCDEPLSILVRNNKGRSSTYEVRLTQTVAHLKQQVSGLEGVQDDLFWLTFEGKPLEDQLPLGEYGLKPLSTVFM
NLRLRGGGTEPGGRS

FIGURE 16

CCAGATCTCAGAGGAGCCTGGCTAAGCAAAACCCTGCAGAACGGCTGCCTAATTTACAGCAACCATGAGTACAAA
TGGTGATGATCATCAGGTCAAGGATAGTCTGGAGCAATTGAGATGTCACTTTACATGGGAGTTATCCATTGATGA
CGATGAAATGCCTGATTTAGAAAACAGAGTCTTGGATCAGATTGAATTCCTAGACACCAAATACAGTGTGGGAAT
ACACAACCTACTAGCCTATGTGAAACACCTGAAAGGCCAGAATGAGGAAGCCCTGAAGAGCTTAAAAGAAGCTGA
AAACTTAATGCAGGAAGAACATGACAACCAAGCAAATGTGAGGAGTCTGGTGACCTGGGGCAACTTTGCCTGGAT
GTATTACCACATGGGCAGACTGGCAGAAGCCCAGACTTACCTGGACAAGGTGGAGAACATTTGCAAGAAGCTTTC
AAATCCCTTCCGCTATAGAATGGAGTGTCCAGAAATAGACTGTGAGGAAGGATGGGCCTTGCTGAAGTGTGGAGG
AAAGAATTATGAACGGGCCAAGGCCTGCTTTGAAAAGGTGCTTGAAGTGGACCCTGAAAACCCTGAATCCAGCGC
TGGGTATGCGATCTCTGCCTATCGCCTGGATGGCTTTAAATTAGCCACAAAAAATCACAAGCCATTTTCTTTGCT
TCCCCTAAGGCAGGCTGTCCGCTTAAATCCAGACAATGGATATATTAAGGTTCTCCTTGCCCTGAAGCTTCAGGA
TGAAGGACAGGAAGCTGAAGGAGAAAAGTACATTGAAGAAGCTCTAGCCAACATGTCCTCACAGACCTATGTCTT
TCGATATGCAGCCAAGTTTTACCGAAGAAAAGGCTCTGTGGATAAAGCTCTTGAGTTATTAAAAAAGGCCTTGCA
GGAAACACCCACTTCTGTCTTACTGCATCACCAGATAGGGCTTTGCTACAAGGCACAAATGATCCAAATCAAGGA
GGCTACAAAAGGGCAGCCTAGAGGGCAGAACAGAGAAAAGCTAGACAAAATGATAAGATCAGCCATATTTCATTT
TGAATCTGCAGTGGAAAAAAAGCCCACATTTGAGGTGGCTCATCTAGACCTGGCAAGAATGTATATAGAAGCAGG
CAATCACAGAAAAGCTGAAGAGAATTTTCAAAAATTGTTATGCATGAAACCAGTGGTAGAAGAAACAATGCAAGA
CATACATTTCTACTATGGTCGGTTTCAGGAATTTCAAAAGAAATCTGACGTCAATGCAATTATCCATTATTTAAA
AGCTATAAAAATAGAACAGGCATCATTAACAAGGGATAAAAGTATCAATTCTTTGAAGAAATTGGTTTTAAGGAA
ACTTCGGAGAAAGGCATTAGATCTGGAAAGCTTGAGCCTCCTTGGGTTCGTCTATAAATTGGAAGGAAATATGAA
TGAAGCCCTGGAGTACTATGAGCGGGCCCTGAGACTGGCTGCTGACTTTGAGAACTCTGTGAGACAAGGTCCTA
GGCACCCAGATATCAGCCACTTTCACATTTCATTTCATTTTATGCTAACATTTACTAATCATCTTTTCTGCTTAC
TGTTTTCAGAAACATTATAATTCACTGTAATGATGTAATTCTTGAATAATAAATCTGACAAAATATT

FIGURE 17

MSTNGDDHQVKDSLEQLRCHFTWELSIDDDEMPDLENRVLDQIEFLDTKYSVGIHNLLAYVKHLKGQNEEALKSL
KEAENLMQEEHDNQANVRSLVTWGNFAWMYYHMGRLAEAQTYLDKVENICKKLSNPFRYRMECPEIDCEEGWALL
KCGGKNYERAKACFEKVLEVDPENPESSAGYAISAYRLDGFKLATKNHKPFSLLPLRQAVRLNPDNGYIKVLLAL
KLQDEGQEAEGEKYIEEALANMSSQTYVFRYAAKFYRRKGSVDKALELLKKALQETPTSVLLHHQIGLCYKAQMI
QIKEATKGQPRGQNREKLDKMIRSAIFHFESAVEKKPTFEVAHLDLARMYIEAGNHRKAEENFQKLLCMKPVVEE
TMQDIHFYYGRFQEFQKKSDVNAIIHYLKAIKIEQASLTRDKSINSLKKLVLRKLRRKALDLESLSLLGFVYKLE
GNMNEALEYYERALRLAADFENSVRQGP

FIGURE 18A

```
GCTAAGCGTCCCAGCCGCATCCCTCCCGCAGCGACGGCGGCCCGGGACCCGCGGGCTGTGAACCATGAACACCCG
CAATAGAGTGGTGAACTCCGGGCTCGGCGCCTCCCCTGCCTCCCGCCCGACCCGGGATCCCCAGGACCCTTCTGG
GCGGCAAGGGGAGCTGAGCCCCGTGGAAGACCAGAGAGAGGGTTTGGAGGCAGCCCCTAAGGGCCCTTCGCGGGA
GAGCGTCGTGCACGCGGGCCAGAGGCGCACAAGTGCATACACCTTGATAGCACCAAATATAAACCGGAGAAATGA
GATACAAAGAAGTATGTATAGTCATTCATTTAACATTCAGAATGCTTCTCTCTTTTACAATTGGTTTGTTTTGG
TGTGAAGTATTTTTATTTTCTCATTTATATAGACTCACCAAATCTCATCAAGGTTTTTGTTTTTTTTAGTTTTG
ATTATACCTTTAAAAATATTCTACTATTAACACTTCTAAGTTTGTTTCTACGTTAGTAACAGAACTCATGACA
TGATGGTAGATCCTGGATTTCTGTTGGCTTGAACAACTTTACACTTATTGCCAATAAACCTCCTTGAGGGTAGGG
ACCACATCTTACTCGTTTTTGTGCTCTCTGTACTTAATGCGTACATAACATGTTTAATTGATGTACAGTAAATAT
AAATGCTGCCATTTAAAGTTATAGCATTATCCTTTAGAGGTGGAAGAGAACTAAAGTTCATTTAGTTCACAAAGA
AATTGTAGGCTTGCTCAAGTCCAGCTGTGGGGCTATGCTGAAATTCGATGGTCTCCTTTATTACATGATTGGTAG
GAAATTTAACTTCATGACTAATGATGGACAGAAAGGCACAAAAGGGAAAAAGCTCTCTAAAGAGTCTCCACCGGA
CATGTAGCTCCGGGTGGGACAGCGGGTCAGTGCAGAATATGACAATCACAGCCATGCAGGGACTATGGGAACTGC
CAGCAGTTCTGGTATCTTACAAGCTTTGATTTAAATACTTAATAGGAGATTAAGTCTCAATGTGGTCTGGATTT
CGAAATGTTTCAGAATTTGTTTTCTAGTAATGGACATTTGAAACAGGTCTCATGAGGAGATAAGGGGAGGCGCT
GGAGTGACAGAACTAATTTCTCTCTGGCGCCCCTGCTGTCGTGCAGAGTGAACATTTAGGAAATGAGCCCTGCT
CCCCAGGAAGCCGACTCTGCACAGTGGTCTGGAGTGCCTGAAACCAGAGCAAGGGTCTCCACCTGTAGCACCGAG
CCCTCATTCCCTAGAGTCGCAGTAAGCTTGGGAGCATTGAAGATAAAGCGAGTATGGGCATCAGAATTCTCTGGG
GATATGTTTACCTATGTGTGGAAAGTTCTTATTGACGTGAAAATATTCTAGTTTTGCACACATTTTCTATAGGTA
ACTTTAAAAATTAACTTGATATAGAGTTTTAAAAATGCCAGAATGGTAGGAAAATCTATACTTCTTTTAGTAGGA
GCCCAGGTGGTTTTCAAATTCGAACCCTCTGTGCTGACTCTTGGTGAGAATGTGCCACAGGGCCGGGCCCAGGA
TGACCTGTACGGGTCAGGGCTGAATATTGTGTTTCTAACCTGGAAGCCTTGTTCACTCATGCTCACATATAGTTA
ATTGCCTTCTAATAGTTGTTTCTTATGCTTTGAAGGGACTGGTTTTCTTTTAGAAGTCTAATAATTGACGATTTG
ATATTTCTCGCCTGGCTTAGTTGCGGAGCAGGAGCTGGCCAACCTGGAGAAGTGGAAGGAGCAGAACAGAGCTAA
ACCGGTTCACCTGGTGCCCAGACGGCTAGGTGGAAGCCAGTCAGAAACTGAAGTCAGACAGAAACAACAACTCCA
GCTGATGCAATCTAAATACAAGCAAAAGCTAAAAAGAGAAGAATCTGTAAGAATCAAGAAGGAAGCTGAAGAAGC
TGAACTCCAAAAAATGAAGGCAATTCAGAGAGAGAAGAGCAATAAACTGGAGGAGAAAAAAGACTTCAAGAAAA
CCTTAGAAGAGAAGCATTTAGAGAGCATCAGCAATACAAAACCGCTGAGTTCTTGAGCAAACTGAACACAGAATC
GCCAGACAGAAGTGCCTGTCAAAGTGCTGTTTGTGGCCCACAATCCTCAACATGGAAACTTCCTATCCTGCCTAG
GGATCACAGCTGGGCCAGAAGCTGGGCTTACAGAGATTCTCTAAAGGCAGAAGAAAACAGAAAATTGCAAAAGAT
GAAGGATGAACAACATCAAAAGAGTGAATTACTGGAACTGAAACGGCAGCAGCAAGAGCAAGAAAGAGCCAAAAT
CCACCAGACTGAACACAGGAGGGTAAATAATGCTTTTCTGGACCGACTCCAAGGCAAAAGTCAACCAGGTGGCCT
CGAGCAATCTGGAGGCTGTTGGAATATGAATAGCGGTAACAGCTGGGGTATATGAGAAAATATTGACTCCTATCT
GGCCTTCATCAACTGACCTCGAAAAGCCTCATGAGATGCTTTTCTTAATGTGATTTGTTCAGCCTCACTGTTT
TTACCTTAATTTCAACTGCCCACACACTTGACCGTGCAGTCAGGAGTGACTGGCTTCTCCTTGTCCTCATTTATG
CATGTTTGGAGGAGCTGATTCCTGAACTCATATTTAAACTCTACTGCCAGGGAAATGCTACATTATTTTTCTAAT
TGGAAGTATAATTAGAGTGATGTTGGTAGGGTAGAAAAGAGGGAGTCACTTGATGCTTTCAGGTTAATCAGAGC
TATGGGTGCTACAGGCTTGTCTTTCTAAGTGACATATTCTTATCTAATTCTCAGATCAGGTTTTGAAAGCTTTGG
GGGTCTTTTTAGATTTTAATCCCTACTTTCTTTATGGTACAAATATGTACAAAAGAAAAAGGTCTTATATTCTTT
TACACAAATTTATAAATAAATTTTGAACTCCTTCTGTATAAATGGGTCATTTTTATTTTTAATGAAAAGTTATTG
GGGTTTCTCTCTTGAAGGGTCTCATTTTAATTCCCTTTTCCAGGCCGTATAGATCAAATATAGTACTGTCATTA
CTGTTGGCTCTTGTTTTGGTCTTGACTTACTAATAGTGTTACCCTGATTTTCAGAGGGGGACAGTTTATCTCCAG
AAAGGCCAATGTTTGTATACACATCAGCTAGACACAAATATAGACATCATATGTAGTTTGTACATGTTTCAGAAA
CTTGTTTTTTCTTTGCTCTGTGTAACCTATTTCCTATTGCTAGTTCAGTTGGCTTTCTTATTCACTTCTGTGACC
CTGAACCAGTTCTCAGACCCTAGAGTGTAAGAGCATTGATTTTCTACGCTGTGTAATCTAGCTCAATCCCTCTGT
CCCCTCCGCCTCACCGTCCCCCAGCCACCACATTGTATAGCAAAAGCATTACATTCAATCCTAGAATAAAGGTAA
ATACAACAAATCATCTTTGCAGCTGGACAACTAATAATACTTTGCAGCATTAAGAGATCTTCTGTGTTACCAGTC
ACTCTGTTGAAATGAACTTTCCGAATCTCTTTATTCAGGAAAACATGGGGTTTTGAAATTCTTGGGCCAAGAGAC
```

FIGURE 18B

```
ATAACTGAGGGGTTCGCAGAGCTAGGCAAGGGTGCACTAGGAAAGGGCCACATTGGTGGGTGGGGGGTAACAGAG
AACAGATGGTGTCAGGAAGTTTCTCTGGAGTAAATAATGTGGATATTCTTGGTTTCCCTCTCCTCCGCCAGCTGA
AGCTGTGTTAGTGCTGTTGACACTAATATAAAATGTTTGGTCCATTTGAAATCCTTGTCATTGCCTTATATGGGG
GAAACTCAATCCCCCAGCCTGTGTTGGAAATATCACCAAACTGATTGTAAATGTGCGGCTGTAGCAGACATTTTA
GTGTGGTGGTGTGCAGCCATTTCGGCCCTACACCTGCCAGCCTGGCTACCTTACAGTTGTGTTCCGATTTTTGCG
TCTATGCTTGGTGTGCCTCACTTGCTGCATTTTCCAGCATGCAACCAGGAGTTGACGTAGGAAAAAGGGATGCTT
TCTTACTTTGGAAGCTCTCAGGGAAGTTGGTGTCAATTTCTCCTCCACTGCCTGGCCTACCCTGCACTCCCAAAG
ATTTTGTGCAGATGGGTAGTTCCATTTTTAAAAATTGTGCAGATATGGAAAATTGTGACTTACTTCATGACCAG
AACTATCTAGAATATGTGTGGGGGTATAAACATCTTGCTTAACCAAATATCTATGTAGGCAGAGGTAACCAGGAG
AGAAGCAAGACTTGCTGCCTAAAGGAGCCCACCATTTTACTTTTCACATTTAATCTGCCACGTTGAATCAATTGG
AATAAAACCTGACTCGCAGGTGACTGGACAGGAAATCCCAAAGTTCCACCATTTCTATGCTTAATTTTAACGTCC
CCCCGCTTTTTTTTGTAGAAAATAAAAACAAGAAAATCGTTCCAATGTAAGATGTTTGTTATAGAAACTTTAGG
CAATACAGGTGTGTAATAAAATGTTTAATAAACTTCTAAACACTTTTGTATTTGGATTTAAAAAAAAAAAAAAAA
AAAA
```

FIGURE 19

MQSKYKQKLKREESVRIKKEAEEAELQKMKAIQREKSNKLEEKKRLQENLRREAFREHQQYKTAEFLSKLNTESP
DRSACQSAVCGPQSSTWKLPILPRDHSWARSWAYRDSLKAEENRKLQKMKDEQHQKSELLELKRQQQEQERAKIH
QTEHRRVNNAFLDRLQGKSQPGGLEQSGGCWNMNSGNSWGI

FIGURE 20

```
AGAGCGGAGGCCGCACTCCAGCACTGCGCAGGGACCGCCTTGGACCGCAGTTGCCGGCCAGGAATCCCAGTGTCA
CGGTGGACACGCCTCCCTCGCGCCCTTGCCGCCCACCTGCTCACCCAGCTCAGGGGCTTTGGAATTCTGTGGCCA
CACTGCGAGGAGATCGGTTCTGGGTCGGAGGCTACAGGAAGACTCCCACTCCCTGAAATCTGGAGTGAAGAACGC
CGCCATCCAGCCACCATTCCAAGGAGGTGCAGGAGAACAGCTCTGTGATACCATTTAACTTGTTGACATTACTTT
TATTTGAAGGAACGTATATTAGAGCTTACTTTGCAAAGAAGGAAG<u>ATG</u>GTTGTTTCCGAAGTGGACATCGCAAAA
GCTGATCCAGCTGCTGCATCCCACCCTCTATTACTGAATGGAGATGCTACTGTGGCCCAGAAAAATCCAGGCTCG
GTGGCTGAGAACAACCTGTGCAGCCAGTATGAGGAGAAGGTGCGCCCCTGCATCGACCTCATTGACTCCCTGCGG
GCTCTAGGTGTGGAGCAGGACCTGGCCCTGCCAGCCATCGCCGTCATCGGGGACCAGAGCTCGGGCAAGAGCTCC
GTGTTGGAGGCACTGTCAGGAGTTGCCCTTCCCAGAGGCAGCGGGATCGTGACCAGATGCCCGCTGGTGCTGAAA
CTGAAGAAACTTGTGAACGAAGATAAGTGGAGAGGCAAGGTCAGTTACCAGGACTACGAGATTGAGATTTCGGAT
GCTTCAGAGGTAGAAAAGGAAATTAATAAAGCCCAGAATGCCATCGCCGGGGAAGGAATGGGAATCAGTCATGAG
CTAATCACCCTGGAGATCAGCTCCCGAGATGTCCCGGATCTGACTCTAATAGACCTTCCTGGCATAACCAGAGTG
GCTGTGGGCAATCAGCCTGCTGACATTGGGTATAAGATCAAGACACTCATCAAGAAGTACATCCAGAGGCAGGAG
ACAATCAGCCTGGTGGTGGTCCCCAGTAATGTGGACATCGCCACCACAGAGGCTCTCAGCATGGCCCAGGAGGTG
GACCCCGAGGGAGACAGGACCATCGGAATCTTGACGAAGCCTGATCTGGTGGACAAAGGAACTGAAGACAAGGTT
GTGGACGTGGTGCGGAACCTCGTGTTCCACCTGAAGAAGGGTTACATGATTGTCAAGTGCCGGGGCCAGCAGGAG
ATCCAGGACCAGCTGAGCCTGTCCGAAGCCCTGCAGAGAGAGAAGATCTTCTTTGAGAACCACCCATATTTCAGG
GATCTGCTGGAGGAAGGAAAGGCCACGGTTCCCTGCCTGGCAGAAAAACTTACCAGCGAGCTCATCACACATATC
TGTAAATCTCTGCCCCTGTTAGAAAATCAAATCAAGGAGACTCACCAGAGAATAACAGAGGAGCTACAAAAGTAT
GGTGTCGACATACCGGAAGACGAAAATGAAAAAATGTTCTTCCTGATAGATAAAATTAATGCCTTTAATCAGGAC
ATCACTGCTCTCATGCAAGGAGAGGAAACTGTAGGGGAGGAAGACATTCGGCTGTTTACCAGACTCCGACACGAG
TTCCACAAATGGAGTACAATAATTGAAAACAATTTTCAAGAAGGCCATAAAATTTGAGTAGAAAAATCCAGAAA
TTTGAAAATCAGTATCGTGGTAGAGAGCTGCCAGGCTTTGTGAATTACAGGACATTTGAGACAATCGTGAAACAG
CAAATCAAGGCACTGGAAGAGCCGGCTGTGGATATGCTACACACCGTGACGGATATGGTCCGGCTTGCTTTCACA
GATGTTTCGATAAAAAATTTTGAAGAGTTTTTTAACCTCCACAGAACCGCCAAGTCCAAAATTGAAGACATTAGA
GCAGAACAAGAGAGAGAAGGTGAGAAGCTGATCCGCCTCCACTTCCAGATGGAACAGATTGTCTACTGCCAGGAC
CAGGTATACAGGGGTGCATTGCAGAAGGTCAGAGAGAAGGAGCTGGAAGAAGAAAAGAAGAAGAAATCCTGGGAT
TTTGGGGCTTTCCAGTCCAGCTCGGCAACAGACTCTTCCATGGAGGAGATCTTTCAGCACCTGATGGCCTATCAC
CAGGAGGCCAGCAAGCGCATCTCCAGCCACATCCCTTTGATCATCCAGTTCTTCATGCTCCAGACGTACGGCCAG
CAGCTTCAGAAGGCCATGCTGCAGCTCCTGCAGGACAAGGACACCTACAGCTGGCTCCTGAAGGAGCGGAGCGAC
ACCAGCGACAAGCGGAAGTTCCTGAAGGAGCGGCTTGCACGGCTGACGCAGGCTCGGCGCCGGCTTGCCCAGTTC
CCCGGT<u>TAA</u>CCACACTCTGTCCAGCCCCGTAGACGTGCACGCACACTGTCTGCCCCCGTTCCCGGGTAGCCACTG
GACTGACGACTTGAGTGCTCAGTAGTCAGACTGGATAGTCCGTCTCTGCTTATCCGTTAGCCGTGGTGATTTAGC
AGGAAGCTGTGAGAGCAGTTTGGTTTCTAGCATGAAGACAGAGCCCCACCCTCAGATGCACATGAGCTGGCGGGA
TTGAAGGATGCTGTCTTCGTACTGGGAAAGGGATTTTCAGCCCTCAGAATCGCTCCACCTTGCAGCTCTCCCCTT
CTCTGTATTCCTAGAAACTGACACATGCTGAACATCACAGCTTATTTCCTCATTTTTATAATGTCCCTTCACAAA
CCCAGTGTTTTAGGAGCATGAGTGCCGTGTGTGCGTCCTGTCGGAGCCCTGTCTCCTCTCTCTGTAATAAACT
CATTTCTAGCAG
```

FIGURE 21

```
MVVSEVDIAKADPAAASHPLLLNGDATVAQKNPGSVAENNLCSQYEEKVRPCIDLIDSLRALGVEQDLALPAIAV
IGDQSSGKSSVLEALSGVALPRGSGIVTRCPLVLKLKKLVNEDKWRGKVSYQDYEIEISDASEVEKEINKAQNAI
AGEGMGISHELITLEISSRDVPDLTLIDLPGITRVAVGNQPADIGYKIKTLIKKYIQRQETISLVVVPSNVDIAT
TEALSMAQEVDPEGDRTIGILTKPDLVDKGTEDKVVDVVRNLVFHLKKGYMIVKCRGQQEIQDQLSLSEALQREK
IFFENHPYFRDLLEEGKATVPCLAEKLTSELITHICKSLPLLENQIKETHQRITEELQKYGVDIPEDENEKMFFL
IDKINAFNQDITALMQGEETVGEEDIRLFTRLRHEFHKWSTIIENNFQEGHKILSRKIQKFENQYRGRELPGFVN
YRTFETIVKQQIKALEEPAVDMLHTVTDMVRLAFTDVSIKNFEEFFNLHRTAKSKIEDIRAEQEREGEKLIRLHF
QMEQIVYCQDQVYRGALQKVREKELEEEKKKKSWDFGAFQSSSATDSSMEEIFQHLMAYHQEASKRISSHIPLII
QFFMLQTYGQQLQKAMLQLLQDKDTYSWLLKERSDTSDKRKFLKERLARLTQARRRLAQFPG
```

FIGURE 22

```
CGGCCTCTCATTTCTCCTAGCCCTTCTGTTCTTCCTTGGCCAAGCTGCAGGGGATTTGGGGGATGTGGGACCTCC
AATTCCCAGCCCCGGCTTCAGCTCTTTCCCAGGTGTTGACTCCAGCTCCAGCTTCAGCTCCAGCTCCAGGTCGGG
CTCCAGCTCCAGCCGCAGCTTAGGCAGCGGAGGTTCTGTGTCCCAGTTGTTTTCCAATTTCACCGGCTCCGTGGA
TGACCGTGGGACCTGCCAGTGCTCTGTTTCCCTGCCAGACACCACCTTTCCCGTGGACAGAGTGGAACGCTTGGA
ATTCACAGCTCATGTTCTTTCTCAGAAGTTTGAGAAAGAACTTTCCAAAGTGAGGGAATATGTCCAATTAATTAG
TTTGTATGAAAAGAAACTGTTAAACCTAACTGTCCGAATTGACATCATGGGAGAAGGATACATTTCTTACACTGA
ACTGGACTTCGAGCTGATAAGGTAGAAGTGAAGGAGATGGAAAAACTGGTCATACAGCTGAAGGAGAGTTTTGGT
GGAAGCTCAGAAATTGTTGACCAGCTGGAGGTGGAGATAAGAAATATGACTCTCTTGGTAGAGAAGCTTGAGACA
CTAGACAAAAACAATGTCCTTGCCATTCGCCGAGAAATCGTGGCTCTGAAGACCAAGCTGAAAGAGTGTGAGGCC
TCTAAAGATCAAAACACCCCTGTCGTCCACCCTCCTCCCACTCCAGGGAGCTGTGGTCATGGTGGTGTGGTGAAC
ATCAGCAAACCGTCTGTGGTTCAGCTCAACTGGAGAGGGTTTTCTTATCTATATGGTGCTTGGGGTAGGGATTAC
TCTCCCCAGCATCCAAACAAAGGACTGTATTGGGTGGCGCCATTGAATACAGATGGGAGACTGTTGGAGTATTAT
ATACTGTACAACACACTGGATGATTTGCTATTGTATATAAATGCTCGAGAGTTGCGGATCACCTATGGCCAAGGT
AGTGGTACAGCAGTTTACAACAACAACATGTACGTCAACATGTACAACACCGGGAATATTGCCAGAGTTAACCTG
ACCACCAACACGATTGCTGTGACTCAAACTCTCCCTAATGCTGCCTATAATAACCGCTTTTCATATGCTAATGTT
GCTTGGCAAGCATATTGACTTTGCTGTGGATGAGAATGGATTGTGGGTTATTTATTCAACTGAAGCCAGCACTGG
TTAACATGGTGATTAGTAAACTCAATGACACCACACTTCAGGTGCTAAACACTTGGTATACCAAGCAGTATAAAC
CATCTGCTTCTAACGCCTTCATGGTATGTGGGGTTCTGTATGCCACCCGTACTATGAACACCAGAACAGAAGAGA
TTTTTTACTATTATGACACAAACACAGGGAAAGAGGGCAAACTAGACATTGTAATGCATAAGATGCAGGAAAAAG
TGCAGAGCATTAACTATAACCCTTTTGACCAGAAACTTTATGTCTATAACGATGGTTACCTTCTGAATTATGATC
TTTCTGTCTTGCAGAAGCCCCAGTAAGCTGTTTAGGAGTTAGGGTGAAAGAGAAATGTTTGTTGAAAAAATAGT
CTTCTCCACTTACTTAGATATCTGCAGATATCTAAGTAAGTGGAGAAGACTATTTTTTCAACAAACATTTTCTCT
TTCACCCTAACTCCTAAACAGCTTACTGGGGCTTCTGCAAGACAGAAAGATCATAATTCAGAAGGTAACCATCGT
TATAGACATAAAGTTTCTGGTCAAAAGGGTTATAGTTAATGCTCTGCACTTTTTCCTGCATCTTATGCATTACAA
TGTCTAGTTTGCCCTCTTTCCCTGTGTTTGTGTCATAATAGTAAAAAATCTCTTCTGTTTGGCGTATAGGGATTC
TTTGTACAGGAAATATTGCCCAATGACTAGTCCTCATCCATGTAGCACCACTAATTCTTCCATGCCTGGAAGAAA
CCTGGGGACTTAGTTAGGTAGATTAATATCTGGAGCTCCTCGAGGGACCAAATCTCCAACTTTTTTTTCCCCTCA
CTAGCACCTGGAATGATGCTTTGTATGTGGCAGATAAGTAAATTTGGCATGCTTATATATTCTACATCTGTAAAG
TGCTGAGTTTTATGGAGAGAGGCCTTTTTATGCATTAAATTGTACATGGCAAATAAATCCCAGAAGGATCTGTAG
ATGAGGCACCTGCTTTTTCTTTTCTCTCATTGTCCACCTTACTAAAAGTCAGTAGAATCTTCTACCTCATAACTT
CCTTCCAAAGGCAGCTCAGAAGATTAGAACCAGACTTACTAACCAATTCCACCCCCCACCAACCCCCTTCTACTG
CCTACTTTAAAAAAATTAATAGTTTTCTATGGAACTGATCTAAGATTAGAAAAATTAATTTTCTTTAATTTCATT
ATGAACTTTTATTTACATGACTCTAAGACTATAAGAAAATCTGATGGCAGTGACAAAGTGCTAGCATTTATTGTT
ATCTAATAAAGACCTTGGAGCATATGTGCAACTTATGAGTGTATCAGTTGTTGCATGTAATTTTTGCCTTTGTTT
AAGCCTGGAACTTGTAAGAAAATGAAAATTTAATTTTTTTTCTAGGACGAGCTATAGAAAAGCTATTGAGAGTA
TCTAGTTAATCAGTGCAGTAGTTGGAAACCTTGCTGGTGTATGTGATGTGCTTCTGTGCTTTTGAATGACTTTAT
CATCTAGTCTTTGTCTATTTTTCCTTTGATGTTCAAGTCCTAGTCTATAGGATTGGCAGTTTAAATGCTTTACTC
CCCCTTTTAAAATAAATGATTAAAATGTGCTTCGAAAAAAAAAAAAAAAAAAAAAAAAAAAAAAAA
```

FIGURE 23

```
MEKLVIQLKESFGSSSEIVDQLEVEIRFMTLLVEKLETLDKNNVLAIRREIVALKTKLKECEASKDQNTPVVHPP
PTPGSCGHGGVVNISKPSVVQLNWRGFSYLYGAWGRDYSPQHPNKGLYWVAPLNTDGRLLEYYILYNTLDDLLLY
INARELRITYGQGSGTAVYNNNMYVNMYNTGNIARVNLTTNTIAVIQTLPNAAYNNRFSYANVAWQAY
```

FIGURE 24

```
CTGAAGAACAAATCAGCCTGGTCACCAGCTTTTCGGAACAGCAGAGACACAGAGGGCAGTCATGAGTGAGGTCAC
CAAGAATTCCCTGGAGAAAATCCTTCCACAGCTGAAATGCCATTTCACCTGGAACTTATTCAAGGAAGACAGTGT
CTCAAGGGATCTAGAAGATAGAGTGTGTAACCAGATTGAATTTTTAAACACTGAGTTCAAAGCTACAATGTACAA
CTTGTTGGCCTACATAAAACACCTAGATGGTAACAACGAGGCAGCCCTGGAATGCTTACGGCAAGCTGAAGAGTT
AATCCAGCAAGAACATGCTGACCAAGCAGAAATCAGAAGTCTAGTCACTTGGGGAAACTACGCCTGGGTCTACTA
TCACTTGGGCAGACTCTCAGATGCTCAGATTTATGTAGATAAGGTGAAACAAACCTGCAAGAAATTTTCAAATCC
ATACAGTATTGAGTATTCTGAACTTGACTGTGAGGAAGGGTGGACACAACTGAAGTGTGGAAGAAATGAAAGGGC
GAAGGTGTGTTTTGAGAAGGCTCTGGAAGAAAAGCCCAACAACCCAGAATTCTCCTCTGGACTGGCAATTGCGAT
GTACCATCTGGATAATCACCCAGAGAAACAGTTCTCTACTGATGTTTTGAAGCAGGCCATTGAGCTGAGTCCTGA
TAACCAATACGTCAAGGTTCTCTTGGGCCTGAAACTGCAGAAGATGAATAAAGAAGCTGAAGGAGAGCAGTTTGT
TGAAGAAGCCTTGGAAAAGTCTCCTTGCCAAACAGATGTCCTCCGCAGTGCAGCCAAATTTTACAGAAGAAAAGG
TGACCTAGACAAAGCTATTGAACTGTTTCAACGGGTGTTGGAATCCACACCAAACAATGGCTACCTCTATCACCA
GATTGGGTGCTGCTACAAGGCAAAAGTAAGACAAATGCAGAATACAGGAGAATCTGAAGCTAGTGGAAATAAAGA
GATGATTGAAGCACTAAAGCAATATGCTATGGACTATTCGAATAAAGCTCTTGAGAAGGGACTGAATCCTCTGAA
TGCATACTCCGATCTCGCTGAGTTCCTGGAGACGGAATGTTATCAGACACCATTCAATAAGGAAGTCCCTGATGC
TGAAAAGCAACAACAATCCCATCAGCGCTACTGCAACCTTCAGAAATATAATGGGAAGTCTGAAGACACTGCTGT
GCAACATGGTTTAGAGGGTTTGTCCATAAGCAAAAAATCAACTGACAAGGAAGAGATCAAAGACCAACCACAGAA
TGTATCTGAAAATCTGCTTCCACAAAATGCACCAAATTATTGGTATCTTCAAGGATTAATTCATAAGCAGAATGG
AGATCTGCTGCAAGCCAAATGTTATGAGAAGGAACTGGGCCGCCTGCTAAGGGATGCCCCTTCAGGCATAGGCAG
TATTTTCCTGTCAGCATCTGAGCTTGAGGATGGTAGTGAGGAAATGGGCCAGGGCGCAGTCAGCTCCAGTCCCAG
AGAGCTCCTCTAACTCAGAGCAACTGAACTGAGACAGAGGAGGAAAACAGAGCATCAGAAGCCTGCAGTGGTG
GTTGTGACGGGTAGGAGGATAGGAAGACAGGGGCCCAACCTGGGATTGCTGAGCAGGGAAGCTTTGCATGTTGC
TCTAAGGTACATTTTTAAAGAGTTGTTTTTTGGCCGGGCGCAGTGCTCATGCCTGTAATCCCAGAACTTTGGGAG
GCCGAGGTGGGCGGATCACGAGGTCTGGAGTTTGAGACCATCCTGGCTAACACAGTGAAATCCCGTCTCTACTAA
AAATACAAAAAATTAGCCAGGCGTGGTGGCTGGCACCTGTAGTCCCAGCTACTTGGGAGGCTGAGGCAGGAGAAT
GGCGTGAACCTGGAAGGAAGAGGTTGCAGAGAGCCAAGATTGCG
```

FIGURE 25

MSEVTKNSLEKILPQLKCHFTWNLFKEDSVSRDLEDRVCNQIEFLNTEFKATMYNLLAYIKHLDGNNEAALECLR
QAEELIQQEHADQAEIRSLVTWGNYAWVYYHLGRLSDAQIYVDKVKQTCKKFSNPYSIEYSELDCEEGWTQLKCG
RNERAKVCFEKALEEKPNNPEFSSGLAIAMYHLDNHPEKQFSTDVLKQAIELSPDNQYVKVLLGLKLQKMNKEAE
GEQFVEEALEKSPCQTDVLRSAAKFYRRKGDLDKAIELFQRVLESTPNNGYLYHQIGCCYKAKVRQMQNTGESEA
SGNKEMIEALKQYAMDYSNKALEKGLNPLNAYSDLAEFLETECYQTPFNKEVPDAEKQQQSHQRYCNLQKYNGKS
EDTAVQHGLEGLSISKKSTDKEEIKDQPQNVSENLLPQNAPNYWYLQGLIHKQNGDLLQAKCYEKELGRLLRDAP
SGIGSIFLSASELEDGSEEMGQGAVSSSPRELLSNSEQLN

FIGURE 26

```
GGGGCATTTTGTGCCTGCCTAGCTATCCAGACAGAGCAGCTACCCTCAGCTCTAGCTGATACTACAGACAGTACA
ACAGATCAAGAAGTATGGCAGTGACAACTCGTTTGACACGGTTGCACGAAAAGATCCTGCAAAATCATTTTGGAG
GGAAGCGGCTTAGCCTTCTCTATAAGGGTAGTGTCCATGGATTCCGTAATGGAGTTTTGCTTGACAGATGTTGTA
ATCAAGGGCCTACTCTAACAGTGATTTATAGTGAAGATCATATTATTGGAGCATATGCGGAAGAGAGTTACCAGG
AAGGAAAGTATGCTTCCATCATCCTTTTTGCACTTCAAGATACTAAAATTTCAGAATGGAAACTAGGACTATGTA
CACCAGAAACACTGTTTTGTTGTGATGTTACAAAATATAACTCCCCAACTAATTTCCAGATAGATGGAAGAAATA
GAAAAGTGATTATGGACTTAAAGACAATGGAAAATCTTGGACTTGCTCAAAATTGTACTATCTCTATTCAGGATT
ATGAAGTTTTTCGATGCGAAGATTCACTGGATGAAAGAAAGATAAAAGGGGTCATTGAGCTCAGGAAGAGCTTAC
TGTCTGCCTTGAGAACTTATGAACCATATGGATCCCTGGTTCAACAAATACGAATTCTGCTGCTGGGTCCAATTG
GAGCTGGGAAGTCCAGCTTTTTCAACTCAGTGAGGTCTGTTTTCCAAGGGCATGTAACGCATCAGGCTTTGGTGG
GCACTAATACAACTGGGATATCTGAGAAGTATAGGACATACTCTATTAGAGACGGGAAAGATGGCAAATACCTGC
CGTTTATTCTGTGTGACTCACTGGGGCTGAGTGAGAAAGAAGGCGGCCTGTGCAGGGATGACATATTCTATATCT
TGAACGGTAACATTCGTGATAGATACCAGTTTAATCCCATGGAATCAATCAAATTAAATCATCATGACTACATTG
ATTCCCCATCGCTGAAGGACAGAATTCATTGTGTGGCATTTGTATTTGATGCCAGCTCTATTCAATACTTCTCCT
CTCAGATGATAGTAAAGATCAAAAGAATTCGAAGGGAGTTGGTAAACGCTGGTGTGGTACATGTGGCTTTGCTCA
CTCATGTGGATAGCATGGATTTGATTACAAAAGGTGACCTTATAGAAATAGAGAGATGTGAGCCTGTGAGGTCCA
AGCTAGAGGAAGTCCAAAGAAAACTTGGATTTGCTCTTTCTGACATCTCGGTGGTTAGCAATTATTCCTCTGAGT
GGGAGCTGGACCCTGTAAAGGATGTTCTAATTCTTTCTGCTCTGAGACGAATGCTATGGGCTGCAGATGACTTCT
TAGAGGATTTGCCTTTTGAGCAAATAGGGAATCTAAGGGAGGAAATTATCAACTGTGCACAAGGAAAAAAATAGA
TATGTGAAAGGTTCACGTAAATTTCCTCACATCACAGAAGATTAAAATTCAGAAAGGAGAAAACACAGACCAAAG
AGAAGTATCTAAGACCAAAGGGATGTGTTTTATTAATGTCTAGGATGAAGAAATGCATAGAACATTGTAGTACTT
GTAAATAACTAGAAATAACATGATTTAGTCATAATTGTGAAAAATAGTAATAATTTTTCTTGGATTTATGTTCTG
TATCTGTGAAAAAATAAATTTCTTATAAAACTCGGAAAAAAAAAAAAAAAAAAAAAAAAAAAAA
```

FIGURE 27

MAVTTRLTRLHEKILQNHFGGKRLSLLYKGSVHGFRNGVLLDRCCNQGPTLTVIYSEDHIIGAYAEESYQEGKYA
SIILFALQDTKISEWKLGLCTPETLFCCDVTKYNSPTNFQIDGRNRKVIMDLKTMENLGLAQNCTISIQDYEVFR
CEDSLDERKIKGVIELRKSLLSALRTYEPYGSLVQQIRILLLGPIGAGKSSFFNSVRSVFQGHVTHQALVGTNTT
GISEKYRTYSIRDGKDGKYLPFILCDSLGLSEKEGGLCRDDIFYILNGNIRDRYQFNPMESIKLNHHDYIDSPSL
KDRIHCVAFVFDASSIQYFSSQMIVKIKRIRRELVNAGVVHVALLTHVDSMDLITKGDLIEIERCEPVRSKLEEV
QRKLGFALSDISVVSNYSSEWELDPVKDVLILSALRRMLWAADDFLEDLPFEQIGNLREEIINCAQGKK

FIGURE 28

```
GCTCCGGCCAGCCGCGGTCCAGAGCGCGCGAGGTTCGGGGAGCTCCGCCAGGCTGCTGGTACCTGCGTCCGCCCG
GCGAGCAGGACAGGCTGCTTTGGTTTGTGACCTCCAGGCAGGACGGCCATCCTCTCCAGAATGAAGATCTTCTTG
CCAGTGCTGCTGGCTGCCCTTCTGGGTGTGGAGCGAGCCAGCTCGCTGATGTGCTTCTCCTGCTTGAACCAGAAG
AGCAATCTGTACTGCCTGAAGCCGACCATCTGCTCCGACCAGGACAACTACTGCGTGACTGTGTCTGCTAGTGCC
GGCATTGGGAATCTCGTGACATTTGGCCACAGCCTGAGCAAGACCTGTTCCCCGGCCTGCCCCATCCCAGAAGGC
GTCAATGTTGGTGTGGCTTCCATGGGCATCAGCTGCTGCCAGAGCTTTCTGTGCAATTTCAGTGCGGCCGATGGC
GGGCTGCGGGCAAGCGTCACCCTGCTGGGTGCCGGGCTGCTGCTGAGCCTGCTGCCGGCCCTGCTGCGGTTTGGC
CCCTGACCGCCCAGACCCTGTCCCCGATCCCCCAGCTCAGGAAGGAAAGCCCAGCCCTTTCTGGATCCCACAGT
GTATGGGAGCCCCTGACTCCTCACGTGCCTGATCTGTGCCCTTGGTCCCAGGTCAGGCCCACCCCCTGCACCTCC
ACCTGCCCCAGCCCCTGCCTCTGCCCAAGTGGGCCAGCTGCCCTCACTTCTGGGGTGGATGATGTGACCTTCCTT
GGGGGACTGCGGAAGGGACGAGGGTTCCCTGGAGTCTTACGGTCCAACATCAGACCAAGTCCCATGGACATGCTG
ACAGGGTCCCCAGGGAGACCGTGTCAGTAGGGATGTGTGCCTGGCTGTGTACGTGGGTGTGCAGTGCACGTGAGA
GCACGTGGCGGCTTCTGGGGGCCATGTTTGGGGAGGGAGGTGTGCCAGCAGCCTGGAGAGCCTCAGTCCCTGTAG
CCCCCTGCCCTGGCACAGCTGCATGCACTTCAAGGGCAGCCTTTGGGGGTTGGGGTTTCTGCCACTTCCGGGTCT
AGGCCCTGCCCAAATCCAGCCAGTCCTGCCCCAGCCCACCCCCACATTGGAGCCCTCCTGCTGCTTTGGTGCCTC
AAATAAATACAGATGTCCCC
```

FIGURE 29

MKIFLPVLLAALLGVERASSLMCFSCLNQKSNLYCLKPTICSDQDNYCVTVSASAGIGNLVTFGHSLSKTCSPAC
PIPEGVNVGVASMGISCCQSFLCNFSAADGGLRASVTLLGAGLLLSLLPALLRFGP

FIGURE 30

```
GCGCGCAGCTGGTTCCCGCTCTGCAGCGCAACGCCTGAGGCAGTGGGCGCGCTCAGTCCCGGGACCAGGCGTTCT
CTCCTCTCGCCTCTGGGCCTGGGACCCGCAAAGCGGCGATGGAGCGGAGGTCGCGGAGGAAGTCGCGGCGCAACG
GGCGCTCGACCGCGGGCAAGGCCGCCGCGACCCAGCCCGCGAAGTCTCCGGGCGCACAGCTCTGGCTCTTTCCCA
GCGCCGCGGGCCTCCACCGCGCGCTGCTCCGGAGGGTGGAGGTGACGCGCCAACTCTGCTGCTCGCCGGGCGCC
TCGCGGTCTTGGAACGCGGCGGGGCGGGCGTCCAGGTTCACCAGCTGCTCGCCGGGAGCGGCGGCGCCCGGACGC
CGAAATGCATTAAATTAGGAAAAAACATGAAGATACATTCCGTGGACCAAGGAGCAGAGCACATGCTGATTCTCT
CATCAGATGGAAAACCATTTGAGTATGACAACTATAGCATGAAACATCTAAGGTTTGAAAGCATTTTACAAGAAA
AAAAAATAATTCAGATCACATGTGGAGATTACCATTCTCTTGCACTCTCAAAAGGCGGTGAGCTTTTTGCCTGGG
GACAGAACCTGCATGGGCAGCTTGGAGTTGGAAGGAAATTTCCCTCAACCACCACACCACAGATTGTGGAGCACC
TCGCAGGAGTACCCTTGGCTCAGATTCTGCCGGAGAAGCCCACAGCATGGCCTTATCCATGTCTGGCAACATTT
ATTCATGGGGAAAAAATGAATGTGGACAACTAGGCCTGGGCACACTGAGAGTAAAGATGATCCATCCCTTATTG
AAGGACTAGACAATCAGAAAGTTGAATTTGTCGCTTGTGGTGGCTCTCACAGTGCCCTACTCACACAGGATGGGC
TGCTGTTTACTTTCGGTGCTGGAAAACATGGGCAACTTGGTCATAATTCAACACAGAATGAGCTAAGACCCTGTT
TGGTGGCTGAGCTTGTTGGGTATAGAGTGACTCAGATAGCATGTGGAAGGTGGCACACACTTGCCTATGTTTCTG
ATTTGGGAAAGGTCTTTTCCTTTGGTTCTGGAAAAGATGGACAACTGGGAAATGGTGGAACACGTGACCAGCTGA
TGCCGCTTCCAGTGAAAGTATCATCAAGTGAAGAACTCAAACTTGAAAGCCATACCTCAGAAAAGGAGTTAATAA
TGATTGCTGGAGGGAATCAAAGCATTTTGCTCTGGATAAAGAAAGAGAATTCATATGTTAATCTGAAGAGGACAA
TTCCTACTCTGAATGAAGGGACTGTAAAGAGATGGATTGCTGATGTGGAGACTAAACGGTGGCAGAGCACAAAAA
GGGAAATCCAAGAGATATTTTCATCTCCTGCTTGTCTAACTGGAAGTTTTTTAAGGAAAAGAAGAACTACAGAAA
TGATGCCTGTTTATTGGACTTAAATAAAGCAAGAAACATCTTCAGGGAGTTAACCCAAAAGGACTGGATTACTA
ACATGATAACCACCTGCCTCAAAGATAATCTGCTCAAAAGACTTCCATTTCATTCTCCACCCCAAGAAGCTTTAG
AAATTTTCTTCCTTCTCCCAGAATGTCCTGTGATGCATATTCCAACAACTGGGAGAGCCTTGTGGTTCCATTTG
CAAAGGTTGTTTGTAAAATGAGTGACCAGTCTTCACTGGTTCTGGAAGAGTATTGGGCAACTCTGCAAGAATCCA
CTTTCAGCAAACTGGTCCAGATGTTTAAAACAGCCGTCATATGCCAGTTGGATTACTGGGATGAAAGTGCTGAGG
AGAATGGTAATGTTCAAGCTCTCCTAGAAATGTTGAAGAAGCTGCACAGGGTAAACCAGGTGAAATGTCAACTAC
CTGAAAGTATTTTCCAAGTAGACGAACTCTTGCACCGTCTCAATTTTTTTGTAGAAGTATGCAGAAGGTACTTGT
GGAAAATGACTGTGGACGCTTCAGAAAATGTACAATGCTGCGTCATATTCAGTCACTTTCCATTTATCTTTAATA
ATCTGTCGAAAATTAAACTACTACATACAGACACACTTTTAAAAATAGAGAGTAAAAAACATAAAGCTTATCTTA
GGTCGGCAGCAATTGAGGAAGAAAGAGAGTCTGAATTCGCTTTGAGGCCCACGTTTGATCTAACAGTCAGAAGGA
ATCACTTGATTGAGGATGTTTGAATCAGCTAAGTCAATTTGAGAATGAAGACCTGAGGAAAGAGTTATGGGTTT
CATTTAGTGGAGAAATTGGGTATGACCTCGGAGGAGTCAAGAAAGAGTTCTTCTACTGTCTGTTTGCAGAGATGA
TCCAGCCGGAATATGGGATGTTCATGTATCCTGAAGGGGCTTCCTGCATGTGGTTTCCTGTCAAGCCTAAATTTG
AGAAGAAAAGATACTTCTTTTTTGGGGTTCTATGTGGACTTTCCCTGTTCAATTGCAATGTTGCCAACCTCCCTT
TCCCACTGGCACTGTTTAAGAAACTTTTGGACCAAATGCCATCATTGGAAGACTTGAAAGAACTCAGTCCTGATT
TGGGAAAGAATTTGCAAACACTTCTGGATGATGAAGGTGATAACTTTGAGGAAGTATTTTACATCCATTTAATG
TGCACTGGGACAGAAACGACACAAACTTAATTCCTAATGGAAGTAGCATAACTGTCAACCAGACTAACAAGAGAG
ACTATGTTTCTAAGTATATCAATTACATTTTCAACGACTCTGTAAAGGCGGTTTATGAAGAATTTCGGAGAGGAT
TTTATAAAATGTGCGACGAAGACATTATCAAATTATTCCACCCCGAAGAACTGAAGGATGTGATTGTTGGAAATA
CAGATTATGATTGGAAAACATTTGAAAAGAATGCACGTTATGAACCAGGATATAACAGTTCACATCCCACCATAG
TGATGTTTTGGAAGGCTTTCCACAAATTGACTCTGGAAGAAAGAAAAAATTCCTTGTATTTCTTACAGGAACTG
ACAGACTACAAATGAAAGATTTAAATAATATGAAAATAACATTTTGCTGTCCTGAAAGTTGGAATGAAAGAGACC
CTATAAGAGCACTGACATGTTTCAGTGTCCTCTTCCTCCCTAAATATTCTACAATGGAAACAGTTGAAGAAGCGC
TTCAAGAAGCCATCAACAACAACAGAGGATTTGGCTGACCAGCTTGCTTGTCCAACAGCCTTATTTGTTGTTGT
TATCGTTGTTGTTGTTGTTGTTGTTGTTTCTACTTTGTTTGTTTAGGCTTTTAGCAGCCTGAAGCCAT
GGTTTTCATTTCTGTCTCTAGTGATAAGCAGGAAAGAGGGATGAAGAAGAGGGTTTACTGGCCGGTTAGAACCC
GTGACTGTATTCTCTCCCTTGGATACCCCTATGCCTACATCATATTCCTTACCTCTTTTGGGAAATATTTTTCAA
AAATAAAATAACCGAAAAACTAAAAAAAGAAAAAAAAAAAAAAAAAAAAAAAA
```

FIGURE 31

MERRSRRKSRRNGRSTAGKAAATQPAKSPGAQLWLFPSAAGLHRALLRRVEVTRQLCCSPGRLAVLERGGAGVQV
HQLLAGSGGARTPKCIKLGKNMKIHSVDQGAEHMLILSSDGKPFEYDNYSMKHLRFESILQEKKIIQITCGDYHS
LALSKGGELFAWGQNLHGQLGVGRKFPSTTTPQIVEHLAGVPLAQISAGEAHSMALSMSGNIYSWGKNECGQLGL
GHTESKDDPSLIEGLDNQKVEFVACGGSHSALLTQDGLLFTFGAGKHGQLGHNSTQNELRPCLVAELVGYRVTQI
ACGRWHTLAYVSDLGKVFSFGSGKDGQLGNGGTRDQLMPLPVKVSSSEELKLESHTSEKELIMIAGGNQSILLWI
KKENSYVNLKRTIPTLNEGTVKRWIADVETKRWQSTKREIQEIFSSPACLTGSFLRKRRITEMMPVYLDLNKARN
IFRELTQKDWITNMITTCLKDNLLKRLPFHSPPQEALEIFFLLPECPVMHISNNWESLVVPFAKVVCKMSDQSSL
VLEEYWATLQESTFSKLVQMFKTAVICQLDYWDESAEENGNVQALLEMLKKLHRVNQVKCQLPESIFQVDELLHR
LNFFVEVCRRYLWKMTVDASENVQCCVIFSHFPFIFNNLSKIKLLHTDTLLKIESKKHKAYLRSAAIEEERESEF
ALRPTFDLTVRRNHLIEDVLNQLSQFENEDLRKELWVSFSGEIGYDLGGVKKEFFYCLFAEMIQPEYGMFMYPEG
ASCMWFPVKPKFEKKRYFFFGVLCGLSLFNCNVANLPFPLALFKKLLDQMPSLEDLKELSPDLGKNLQTLLDDEG
DNFEEVFYIHFNVHWDRNDTNLIPNGSSITVNQTNKRDYVSKYINYIFNDSVKAVYEEFRRGFYKMCDEDIIKLF
HPEELKDVIVGNTDYDWKTFEKNARYEPGYNSSHPTIVMFWKAFHKLTLEEKKKFLVFLTGTDRLQMKDLNNMKI
TFCCPESWNERDPIRALTCFSVLFLPKYSTMETVEEALQEAINNNRGFG

FIGURE 32

GGTGAAATGGGGATGGAAAAGGGTTATATAAAAACAAATAATGGTAACAATAATGATGAAGATTGGAGTACTCCA
TCTCNNNNNNNNNNNNNNNNNNNNNNNNNNNNNNNNNNNNNNNNNNNCATGTTCATTATAGTTCATTACAGTTACATA
GTCCGAAGGTCTTACAACTAATCACTGGTAGCAATAAATGCTTCAGGCCCACATGATGCTGATTAGTTCTCAGTT
TTCATTCAGTTCACAATATAACCACCATTCCTGCCCTCCCTGCCAAGGGTCATAAATGGTGACTGCCTAACAACA
AAATTTGCAGTCTCATCTCATTTTCATCCAGACTTCTGGAACTCAAAGATTAACTTTTGACTAACCCTGGAATAT
CTCTTATCTCACTTATAGCTTCAGGCATGTATTTATATGTATTCTTGATAGCAATACCATAATCAATGTGTATTC
CTGATAGTAATGCTACAATAAATCCAAACATTTCAACTCTGTTAGAATAGAGGTAATTGTGTGGTTTGTGTATGG
GACTATAACAGTAATATTAATTCCCAAAATTTCTCCTACTAGGAACAGTGGGTA

FIGURE 33

GEMGMEKGYIKTNNGNNNDEDWSTPSXXXXXXXXXXXXXXMFIIVHYSYIVRRSYN

FIGURE 34

TGAGGATCAAAAAACTACCTATCTGGTACTATGCTTTTTATCTGGATGATGAAATAATCTGTACAACAAACCCTG
GTGACATGCAATTTACCTATATAGCAAGCCTACACATGTGCCCCTGAACCTAAAAAAAAAGTTAAAAGAAAAACG
TTTGGATTATTTTCCCTCTTTCGAACAAAGACATTGGTTTGCCCAAGGACTACAAATAAACCAACGGGAAAAAG
AAAGGTTCCAGTTTTGTCTGAAAATTCTGATTAAGCCTCTGGGCCCTACAGCCTGGAGAACCTGGAGAATCCTAC
ACCCACAGAACCCGGCTTTGTCCCCAAAGAATAAAAACACCTCTCTG

FIGURE 35

RIKKLPIWYYAFYLDDEIICTTNPGDMQFTYIASLHMCP

FIGURE 36

```
ATATCTTATAAATGAAGTCTCCTCATTTTCCTGTGGTCAGAAGAGAGGGGGCAAGCAGAAAAGCAGAGGAACAAA
TTTGGAGGCTAAAATAACATTCTACATAAGGAACTATACTACAGTAGAATTAATTGATAGCAGGGATTAAGAGAT
GTAAATGAATTTGAGATACATATTCTAGAGGTAGAATGTGCAATACTTTTTGTATGTCCATATACAGAAATTGGT
TGCATTTTCCTTAAATAAAAAGATTTTTTAAAAGTTAGTGAGCTGTTATGTTTTCTTCCCTCTGACTTCAATTCC
TTGATTCTTTCAATTTTTTTAATATAAATTTACTGTCTAAAAGCTGGATCAGCTTATGCTCCTTTGTTGAGAGAA
GTTGGCATGCTGTCAAGTGGGCTGGGCACACTGAGTTTCAGTTTCCTTTCTCTGAGTCTTTGAAGCTTCAAGGCT
GCTGAATAATTTCCTTCTCCCATTTTGTGCCTGCCTAGCTATCCAGACAGAGCAGCTACCCTCAGCTCTAGCTGA
TACTACAGACAGTACAACAGATCAAGAAGTATGGCAGTGACAACTCGTTTGACATGGTTGCACGAAAAGATCCTG
CAAAATCATTTTGGAGGGAAGCGGCTTAGCCTTCTCTATAAGGGTAGTGTCCATGGATTCCGTAATGGAGTTTTG
CTTGACAGATGTTGTAATCAAGGGCCTACTCTAACAGTGATTTATAGTGAAGATCATATTATTGGAGCATATGCA
GAAGAGAGTTACCAGGAAGGAAAGTATGCTTCCATCATCCTTTTTGCACTTCAAGATACTAAAATTTCAGAATGG
AAACTAGGACTATGTACACCAGAAACACTGTTTTGTTGTGATGTTACAAAATATAACTCCCCAACTAATTTCCAG
ATAGATGGAAGAAATAGAAAAGTGATTATGGACTTAAAGACAATGGAAAATCTTGGACTTGCTCAAAATTGTACT
ATCTCTATTCAGGATTATGAAGTTTTTCGATGCGAAGATTCACTGGATGAAAGAAAGATAAAAGGGGTCATTGAG
CTCAGGAAGAGCTTACTGTCTGCCTTGAGAACTTATGAACCATATGGATCCCTGGTTCAACAAATACGAATTCTG
CTGCTGGGTCCAATTGGAGCTGGGAAGTCCAGCTTTTTCAACTCAGTGAGGTCTGTTTTCCAAGGGCATGTAACG
CATCAGGCTTTGGTGGGCACTAATACAACTGGGATATCTGAGAAGTATAGGACATACTCTATTAGAGACGGGAAA
GATGGCAAATACCTGCCGTTTATTCTGTGTGACTCACTGGGGCTGAGTGAGAAAGAAGGCGGCCTGTGCAGGGAT
GACATATTCTATATCTTGAACGGTAACATTCGTGATAGATACCAGTTTAATCCCATGGAATCAATCAAATTAAAT
CATCATGACTACATTGATTCCCCATCGCTGAAGGACAGAATTCATTGTGTGGCATTTGTATTTGATGCCAGCTCT
ATTCAATACTTCTCCTCTCAGATGATAGTAAAGATCAAAAGAATTCGAAGGGAGTTGGTAAACGCTGGTGTGGTA
CATGTGGCTTTGCTCACTCATGTGGATAGCATGGATTTGATTACAAAAGGTGACCTTATAGAAATAGAGAGATGT
GAGCCTGTGAGGTCCAAGGTAATGAATGATGCCCTTCGTAAACACATTTCTGGGCTAGAGGAAGTCCAAAGAAA
ACAGAGTAAACATCTGCCAACGTTTATTGACAGTGCTGAGCAGTGACAGATAAATATTTCGAACCTAGGCAGTTT
GATTCTAGAGGTAAAATAGTCTAAACAAGAATTAAACGTTAAACTGGTCTAATAAAATCTACTTATCCAGAGAAT
GTTTTTAAAAGAAACAGGAAATATATGGACTGTAGGATAGGTGTCATAAAAATTTTGTTTCTAAATCATTTAGA
ATCCACTGCATGTATTCCAAATTACAATTATCAGTGACATTAGAACTTGATATGTGAAGTTCTTCAAGAGTACTT
TGTGAGACCAGATCTCCATTTTTTCCAATGGGAAATTATTGCAAGTTCCTACATCTTGATATTGCTTTCGTAAT
TTATACTAACATAAAATAATATTTTTCACTGTTTTGCAATGTCTTTTTAATTTCTGTATTGCAGCTAGAGGAAGT
CCAAAGAAAACTTGGATTTGCTCTTTCTGACATCTCGGTGGTTAGCAATTATTCCTCTGAGTGGGAGCTGGACCC
TGTAAAGGATGTTCTAATTCTTTCTGCTCTGAGACGAATGCTATGGGCTGCAGATGACTTCTTAGAGGATTTGCC
TTTTGAGCAAATAGGTAGATGTGTTTGGTGGTGTGGAAGCTTGGAAGCGGTCAGGTAGTTGGCTACTTTCTGCTT
GGATCTATTAAATACCTGGCAGCTCTCTGTCTTTTTGTGGGTTGTTGCCCTGTGATTAGTTCTGCTTTTTAACCC
ACTCCCTGGATGCATTTTTCCCTCCTTGCATTTCCCTCTTTTCCTGGAGTTCATACTAGAGAATCTGCACTATGT
TTTTCCCTTTTTGTCTTGAGATGAAAGTTTTAAAATAATCCACCTCTGTCATTTCCACTCTCTGAACATCCCAAG
CTGTATCCCTGGCCTCTTTTCTCAGACTATGTTTCTTTACTTGGGACCTAGAACTGGATTGGATTGGCATTGCTC
CTGATCAGATGAGACCTTTGATTATTTGCCCCTTCCTTAGGACCTTACACTCCTGTCTTTCTTTGACTTGCCTTT
TTGTTTCTTTCCTTCATCTTAGTCCCTCTTCATGCAGTATGGTCATTGCTAGGTAGAGGTATGTCCTTTTATGTA
ATGGCCACCGCATTTAGTATTACATAAACTTTCTTTTAACAATCTGTGCATAGTACATGCTGCTCTGTTCCATTT
AGAGATTTGACAGAGGTTTCAGTTTAGTATACTCAAATCTTATTTTAGTGCTTGGGAAATCAATTCAGAATATCA
CATCCTCTCCAATTCTCTCTTACTCAAATTGCTGGGAAACTCTCATGTTACTAACTTTGTTGCTCTAACTCTGCC
ATCTTGGTTTCCCCATCCCTTCTCTTCCTCATGGTACGTGTGCTCCTAATATTAGCGTTGGTTGAGATTTTCAGT
GGTCCAATATTCCTCTTCCCTCTGGTTGCCTTTCCTGAGATAATCCACTAAGAATATTTTGTGTTTCTTTTCTCA
GGGAATCTAAGGGAGGAAATTATCAACTGTGCACAAGGAAAAAAATAGATATGTGAAAGGTTCACGTAAATTTCC
TCACATCACAGAAGATTAAAATTCAGAAAGGAGAAAACACAGACCAAAGAGAAGTATCTAAGACCAAAGGGATGT
GTTTTATTAATGTCTAGGATGAAGAAATGCATAGAACATTGTAGTACTTGTAAATAACTAGAAATAACATGATTT
AGTCATAATTGTGAAAAATAATAATAATTTTTCTTGGATTTATGTTCTGTATCTGTGAAAAAATAAATTTCTTAT
AAAACTCGGAAGTATGTAGTCGGGTACCG
```

FIGURE 37

MAVTTRLTWLHEKILQNHFGGKRLSLLYKGSVHGFRNGVLLDRCCNQGPTLTVIYSEDHIIGAYAEESYQEGKYA
SIILFALQDTKISEWKLGLCTPETLFCCDVTKYNSPTNFQIDGRNRKVIMDLKTMENLGLAQNCTISIQDYEVFR
CEDSLDERKIKGVIELRKSLLSALRTYEPYGSLVQQIRILLLGPIGAGKSSFFNSVRSVFQGHVTHQALVGTNTT
GISEKYRTYSIRDGKDGKYLPFILCDSLGLSEKEGGLCRDDIFYILNGNIRDRYQFNPMESIKLNHHDYIDSPSL
KDRIHCVAFVFDASSIQYFSSQMIVKIKRIRRELVNAGVVHVALLTHVDSMDLITKGDLIEIERCEPVRSKVMND
ALRKHIFWARGSPKKTE

FIGURE 38

```
GCTCTCCAGAGGCGGGCCCTGAGCCGGCACCTCCCCTTTCGGACAGCTCAAGGGACTCAGCCAACTGGCTCACGC
CTCCCCTTCAGCTTCTCTTCACGCACTCCAAGATCTAAACCGAGAATCGAAACTAAGCTGGGGTCCATGGAGCCT
GCACCCGCCCGATCTCCGAGGCCCCAGCAGGACCCCGCCCGGCCCCAGGAGCCCACCATGCCTCCCCCCGAGACC
CCCTCTGAAGGCCGCCAGCCCAGCCCCAGCCCCAGCCCTACAGAGCGAGCCCCCGCTTCGGAGGAGGAGTTCCAG
TTTCTGCGCTGCCAGCAATGCCAGGCGGAAGCCAAGTGCCCGAAGCTGCTGCCTTGTCTGCACACGCTGTGCTCA
GGATGCCTGGAGGCGTCGGGCATGCAGTGCCCCATCTGCCAGGCGCCCTGGCCCCTAGGTGCAGACACACCCGCC
CTGGATAACGTCTTTTTCGAGAGTCTGCAGCGGCGCCTGTCGGTGTACCGGCAGATTGTGGATGCGCAGGCTGTG
TGCACCCGCTGCAAAGAGTCGGCCGACTTCTGGTGCTTTGAGTGCGAGCAGCTCCTCTGCGCCAAGTGCTTCGAG
GCACACCAGTGGTTCCTCAAGCACGAGGCCCGGCCCCTAGCAGAGCTGCGCAACCAGTCGGTGCGTGAGTTCCTG
GACGGCACCCGCAAGACCAACAACATCTTCTGCTCCAACCCCAACCACCGCACCCCTACGCTGACCAGCATCTAC
TGCCGAGGATGTTCCAAGCCGCTGTGCTGCTCGTGCGCGCTCCTTGACAGCAGCCACAGTGAGCTCAAGTGCGAC
ATCAGCGCAGAGATCCAGCAGCGACAGGAGGAGCTGGACGCCATGACGCAGGCGCTGCAGGAGCAGGATAGTGCC
TTTGGCGCGGTTCACGCGCAGATGCACGCGGCCGTCGGCCAGCTGGGCCGCGCGTGCCGAGACCGAGGAGCTG
ATCCGCGAGCGCGTGCGCCAGGTGGTAGCTCACGTGCGGGCTCAGGAGCGCGAGCTGCTGGAGGCTGTGGACGCG
CGGTACCAGCGCGACTACGAGGAGATGGCCAGTCGGCTGGGCCGCCTGGATGCTGTGCTGCAGCGCATCCGCACG
GGCAGCGCGCTGGTGCAGAGGATGAAGTGCTACGCCTCGGACCAGGAGGTGCTGGACATGCACGGTTTCCTGCGC
CAGGCGCTCTGCCGCCTGCGCCAGGAGGAGCCCCAGAGCCTGCAAGCTGCCGTGCGCACCGATGGCTTCGACGAG
TTCAAGGTGCGGCTGCAGGACCTCAGCTCTTGCATCACCCAGGGGAAAGATGCAGCTGTATCCAAGAAAGCCAGC
CCAGAGGCTGCCAGCACTCCCAGGGACCCTATTGACGTTGACCTGGATGTCTCCAATACAACGACAGCCCAGAAG
AGGAAGTGCAGCCAGACCCAGTGCCCCAGGAAGGTCATCAAGATGGAGTCTGAGGAGGGGAAGGAGGCAAGGTTG
GCTCGGAGCTCCCCGGAGCAGCCCAGGCCCAGCACCTCCAAGGCAGTCTCACCACCCCACCTGGATGGACCGCCT
AGCCCCAGGAGCCCCGTCATAGGAAGTGAGGTCTTCCTGCCCAACAGCAACCACGTGGCCAGTGGCGCCGGGGAG
GCAGAGGAACGCGTTGTGGTGATCAGCAGCTCGGAAGACTCAGATGCCGAAAACTCGTGCATGGAGCCCATGGAG
ACCGCCGAGCCACAGTCCTCGCCAGCCCACTCCTCGCCAGCCCACTCCTCGCCAGCCCACTCCTCGCCAGTCCAG
TCTCTGCTGAGAGCACAAGGAGCCTCCAGCCTGCCCTGTGGCACATACCACCCCCAGCTTGGCCTCCCCACCAG
CCCGCTGAGCAGGCTGCCACCCCCGATGCTGAGCCTCACAGCGAGCCTCCTGATCACCAGGAGCGCCCTGCCGTC
CACCGTGGGATCCGCTACCTGTTGTACAGAGCACAGAGAGCCATCCGCCTTCGCCATGCCCTCCGCTTGCACCCT
CAATTGCATCGGGCCCCTATTCGGACTTGGTCTCCCCATGTGGTCCAAGCCAGCACTCCTGCCATCACAGGGCCC
CTCAACCATCCTGCCAATGCCCAGGAACATCCTGCCCAGCTGCAAAGGGGCATCAGCCCACCCCACCGGATACGA
GGGGCTGTGCGATCCCGCAGCCGCTCCCTCGGGGCTCCTCCCATTTATCCCAGTGGCTCAACAACTTTTTTGCC
CTCCCCTTCTCCTCCATGGCTTCCCAGCTTGACATGTCTTCCGTGGTGGGGGCAGGGGAAGGCAGAGCCCAGACT
CTTGGAGCAGTTGTTCCCCCTGGGGACTCTGTCAGAGGCTCCATGGAGGCCTCTCAAGTCCAAGTGCCTCTGGAA
GCCTCTCCAATTACATTCCCACCACCCTGTGCCCCAGAAAGGCCCCCATCAGCCCAGTCCCAGGCGCCCGTCAA
GCAGGCCTCTGAGAGTGCTACCCTTCTCTTGTAACCTTGCAGCCAACACCCCTGCCCGGCCCCTGAGCTGCCTCC
TCCAGCCCATGCTCTTACAGGCCCTGCACAGAGTAGCACTCATTAATTCTTGGTTAAGGAATGAATCAACGAATG
AATGGCTATGCATGGACCTCTGGGCAGGGAGACCTGGGTCTTCTCTGGCTGAGAGGGGAAGGCTAAGGCATGGCT
GAGATTCAAGCCACCATTCCAGGCCTCTTTGCCCAAGAAAGAAACTTCTGTCACCCTTGCACTCTCCTGTGTTCT
GAGTCCCTGGCCAATAGCACAGCCTTCCATGCCCCGACCCCCACCCCAAGCCTCTCCACTAGGCCTCTGCCAGGA
TCTAAGCCCATGAGCACAGGGACTGGCTATCCCAAGACCTGGCAGATGTGGCTGCTCAATAAACACTTGTTGAAC
CATCAAAAAAAAAAAAAAAAAAAAAAAA
```

FIGURE 39

MEPAPARSPRPQQDPARPQEPTMPPPETPSEGRQPSPSPSPTERAPASEEEFQFLRCQQCQAEAKCPKLLPCLHT
LCSGCLEASGMQCPICQAPWPLGADTPALDNVFFESLQRRLSVYRQIVDAQAVCTRCKESADFWCFECEQLLCAK
CFEAHQWFLKHEARPLAELRNQSVREFLDGTRKTNNIFCSNPNHRTPTLTSIYCRGCSKPLCCSCALLDSSHSEL
KCDISAEIQQRQEELDAMTQALQEQDSAFGAVHAQMHAAVGQLGRARAETEELIRERVRQVVAHVRAQERELLEA
VDARYQRDYEEMASRLGRLDAVLQRIRTGSALVQRMKCYASDQEVLDMHGFLRQALCRLRQEEPQSLQAAVRTDG
FDEFKVRLQDLSSCITQGKDAAVSKKASPEAASTPRDPIDVDLDVSNTTTAQKRKCSQTQCPRKVIKMESEEGKE
ARLARSSPEQPRPSTSKAVSPPHLDGPPSPRSPVIGSEVFLPNSNHVASGAGEAEERVVVISSSEDSDAENSCME
PMETAEPQSSPAHSSPAHSSPAHSSPVQSLLRAQGASSLPCGTYHPPAWPPHQPAEQAATPDAEPHSEPPDHQER
PAVHRGIRYLLYRAQRAIRLRHALRLHPQLHRAPIRTWSPHVVQASTPAITGPLNHPANAQEHPAQLQRGISPPH
RIRGAVRSRSRSLRGSSHLSQWLNNFFALPFSSMASQLDMSSVVGAGÉGRAQTLGAVVPPGDSVRGSMEASQVQV
PLEASPITFPPPCAPERPPISPVPGARQAGL

FIGURE 40

CGCCCGGGCAGGTTAGAATTCAGCGACCGCTTAATTCTAGGCTCAGTCCCGACGTGGAACTCAGCAGCGGAGGCT
GGACGCTTGCATGGCGCTTGAGAGATTCCATCGTGCCTGGCTCACATAAGCGCTTCCTGGAAGTGAAGTCGTGCT
GTCCTGAACGCGGGCCAGGCAGCTGCGGCCTGGGGGTTTTGGAGTGATCACGAATGAGCAAGGCGTTTGGGCTCC
TGAGGCAAATCTGTCAGTCCATCCTGGCTGAGTCCTCGCAGTCCCCGGCAGATCTTGAAGAAAAGAAGGAAGAAG
ACAGCAACATGAAGAGAGAGCAGCCCAGAGAGCGTCCCAGGGCCTGGGACTACCCTCATGGCCTGGTTGGTTTAC
ACAACATTGGACAGACCTGCTGCCTTAACTCCTTGATTCAGGTGTTCGTAATGAATGTGGACTTCACCAGGATAT
TGAAGAGGATCACGGTGCCCAGGGGAGCTGACGAGCAGAGGAGAAGCGTCCCTTTCCAGATGCTTCTGCTGCTGG
AGAAGATGCAGGACAGCCGGCAGAAAGCAGTGCGGCCCCTGGAGCTGGCCTACTGCCTGCAGAAGTGCAACGTGC
CCTTGTTTGTCCAACATGATGCTGCCCAACTGTACCTCAAACTCTGGAACCTGATTAAGGACCAGATCACTGATG
TGCACTTGGTGGAGAGACTGCAGGCCCTGTATACGATCCGGGTGAAGGACTCCTTGATTTGCGTTGACTGTGCCA
TGGAGAGTAGCAGAAACAGCAGCATGCTCACCCTCCCACTTTCTCTTTTTGATGTGGACTCAAAGCCCCTGAAGA
CACTGGAGGACGCCCTGCACTGCTTCTTCCAGCCCAGGGAGTTATCAAGCAAAAGCAAGTGCTTCTGTGAGAACT
GTGGGAAGAAGACCCGTGGGAAACAGGTCTTGAAGCTGACCCATTTGCCCCAGACCCTGACAATCCACCTCATGC
GATTCTCCATCAGGAATTCACAGACGAGAAAGATCTGCCACTCCCTGTACTTCCCCAGAGCTTGGATTTCAGCC
AGATCCTTCCAATGAAGCGAGAGTCTTGTGATGCTGAGGAGCAGTCTGGAGGGCAGTATGAGCTTTTTGCTGTGA
TTGCGCACGTGGGAATGGCAGACTCCGGTCATTACTGTGTCTACATCCGGAATGCTGTGGATGGAAAATGGTCTT
GCTTCAATGACTCCAATATTTGCTTGGTGTCCTGGGAAGACATCCAGTGTACCTACGGAAATCCTAACTACCACT
GGCAGGAAACTGCATATCTTCTGGTTTACATGAAGATGGAGTGCTAATGGAAATGCCCAAAACCTTCAGAGATTG
ACACGCTGTCATTTTCCATTTCCGTTCCTGGATCTACGGAGTCTTCTAAGAGATTTTGCAATGAGGAGAAGCATT
GTTTTCAAACTATATAACTGACCTTATTTATAATTAGGGATATTATCAAAATATGTAACCATGAGGCCCCTCAGG
TCCTGATCAGTCAGAATGGATGCTTTCACCAGCAGACCCGGCCATGTGGCTGCTCGGTCCTGGGTGCTCGCTGCT
GTGCAAGACATTAGCCCTTTAGTTATGAGCCTGTGGGAACTTCAGGGGTTCCCAGTGGGGAGAGCAGTGGCAGTG
GGAGGCATCTGGGGGCCAAAGGTCAGTGGCAGGGGGTATTTCAGTATTATACAACTGCTGTGACCAGACTTGTAT
ACTGGCTGAATATCAGTGCTGTTTGTAATTTTTCACTTTGAGAACCAACATTAATTCCATATGAATCAAGTGTTT
TGTAACTGCTATTCATTTATTCAGCAAATATTTATTGAGCATCTCTTCTCCATAAGATAGTGTGATAAACACGGT
CATGAATAAAGTTATTTTCCCCGAAAAAAAAAAAAAAAAAAAAAAAAAAA

FIGURE 41

MSKAFGLLRQICQSILAESSQSPADLEEKKEEDSNMKREQPRERPRAWDYPHGLVGLHNIGQTCCLNSLIQVFVM
NVDFTRILKRITVPRGADEQRRSVPFQMLLLLEKMQDSRQKAVRPLELAYCLQKCNVPLFVQHDAAQLYLKLWNL
IKDQITDVHLVERLQALYTIRVKDSLICVDCAMESSRNSSMLTLPLSLFDVDSKPLKTLEDALHCFFQPRELSSK
SKCFCENCGKKTRGKQVLKLTHLPQTLTIHLMRFSIRNSQTRKICHSLYFPQSLDFSQILPMKRESCDAEEQSGG
QYELFAVIAHVGMADSGHYCVYIRNAVDGKWSCFNDSNICLVSWEDIQCTYGNPNYHWQETAYLLVYMKMEC

FIGURE 42

```
CGCTAAGCGTCCCAGCCGCATCCCTCCCGCAGCGACGGCGGCCCGGGACCCGCGGGCTGTGAACCATGAACACCC
GCAATAGAGTGGTGAACTCCGGGCTCGGCGCCTCCCCTGCCTCCCGCCCGACCCGGGATCCCCAGGACCCTTCTG
GGCGGCAAGGGGAGCTGAGCCCCGTGGAAGACCAGAGAGAGGGTTTGGAGGCAGCCCCTAAGGGCCCTTCGCGGG
AGAGCGTCGTGCACGCGGGCCAGAGGCGCACAAGTGCATACACCTTGATAGCACCAAATATAAACCGGAGAAATG
AGATACAAAGAATTGCGGAGCAGGAGCTGGCCAACCTGGAGAAGTGGAAGGAGCAGAACAGAGCTAAACCGGTTC
ACCTGGTGCCCAGACGGCTAGGTGGAAGCCAGTCAGAAACTGAAGTCAGACAGAAACAACAACTCCAGCTGATGC
AATCTAAATACAAGCAAAAGCTAAAAAGAGAAGAATCTGTAAGAATCAAGAAGGAAGCTGAAGAAGCTGAACTCC
AAAAAATGAAGGCAATTCAGAGAGAGAAGAGCAATAAACTGGAGGAGAAAAAAAGACTTCAAGAAAACCTTAGAA
GAGAAGCATTTAGAGAGCATCAGCAATACAAAACCGCTGAGTTCTTGAGCAAACTGAACACAGAATCGCCAGACA
GAAGTGCCTGTCAAAGTGCTGTTTGTGGCCCACAATCCTCAACATGGGCCAGAAGCTGGGCTTACAGAGATTCTC
TAAAGGCAGAAGAAAACAGAAAATTGCAAAAGATGAAGGATGAACAACATCAAAAGAGTGAATTACTGGAACTGA
AACGGCAGCAGCAAGAGCAAGAAAGAGCCAAAATCCACCAGACTGAACACAGGAGGGTAAATAATGCTTTTCTGG
ACCGACTCCAAGGCAAAAGTCAACCAGGTGGCCTCGAGCAATCTGGAGGCTGTTGGAATATGAATAGCGGTAACA
GCTGGGGTATATGAGAAAATATTGACTCCTATCTGGCCTTCATCAACTGACCTCGAAAAGCCTCATGAGATGCTT
TTTCTTAATGTGATTTTGTTCAGCCTCACTGTTTTTACCTTAATTTCAACTGCCCACACACTTGACCGTGCAGTC
AGGAGTGACTGGCTTCTCCTTGTCCTCATTTATGCATGTTGGAGGAGCTGATTCCTGAACTCATATTTAAACTC
TACTGCCAGGGAAATGCTACATTATTTTTCTAATTGGAAGTATAATTAGAGTGATGTTGGTAGGGTAGAAAAAGA
GGGAGTCACTTGATGCTTTCAGGTTAATCAGAGCTATGGGTGCTACAGGCTTGTCTTTCTAAGTGACATATTCTT
ATCTAATTCTCAGATCAGGTTTTGAAAGCTTTGGGGGTCTTTTTAGATTTTAATCCCTACTTTCTTTATGGTACA
AATATGTACAAAAGAAAAAGGTCTTATATTCTTTTACACAAATTTATAAATAAATTTTGAACTCCTTCTGTAAAA
AAAAAAAA
```

FIGURE 43

MNTRNRVVNSGLGASPASRPTRDPQDPSGRQGELSPVEDQREGLEAAPKGPSRESVVHAGQRRTSAYTLIAPNIN
RRNEIQRIAEQELANLEKWKEQNRAKPVHLVPRRLGGSQSETEVRQKQQLQLMQSKYKQKLKREESVRIKKEAEE
AELQKMKAIQREKSNKLEEKKRLQENLRREAFREHQQYKTAEFLSKLNTESPDRSACQSAVCGPQSSTWARSWAY
RDSLKAEENRKLQKMKDEQHQKSELLELKRQQQEQERAKIHQTEHRRVNNAFLDRLQGKSQPGGLEQSGGCWNMN
SGNSWGI

FIGURE 44

```
GAGGCAGTTCTGTTGCCACTCTCTCTCCTGTCAATGATGGATCTCAGAAATACCCCAGCCAAATCTCTGGACAAG
TTCATTGAAGACTATCTCTTGCCAGACACGTGTTTCCGCATGCAAATCGACCATGCCATTGACATCATCTGTGGG
TTCCTGAAGGAAAGGTGCTTCCGAGGTAGCTCCTACCCTGTGTGTGTGTCCAAGGTGGTAAAGGGTGGCTCCTCA
GGCAAGGGCACCACCCTCAGAGGCCGATCTGACGCTGACCTGGTTGTCTTCCTCAGTCCTCTCACCACTTTTCAG
GATCAGTTAAATCGCCGGGGAGAGTTCATCCAGGAAATTAGGAGACAGCTGGAAGCCTGTCAAAGAGAGAGAGCA
CTTTCCGTGAAGTTTGAGGTCCAGGCTCCACGCTGGGGCAACCCCCGTGCGCTCAGCTTCGTACTGAGTTCGCTC
CAGCTCGGGGAGGGGGTGGAGTTCGATGTGCTGCCTGCCTTTGATGCCCTGGGTCAGTTGACTGGCAGCTATAAA
CCTAACCCCCAAATCTATGTCAAGCTCATCGAGGAGTGCACCGACCTGCAGAAAGAGGGCGAGTTCTCCACCTGC
TTCACAGAACTACAGAGAGACTTCCTGAAGCAGCGCCCCACCAAGCTCAAGAGCCTCATCCGCCTAGTCAAGCAC
TGGTACCAAAATTGTAAGAAGAAGCTTGGGAAGCTGCCACCTCAGTATGCCCTGGAGCTCCTGACGGTCTATGCT
TGGGAGCGAGGGAGCATGAAAACACATTTCAACACAGCCCAAGGATTTCGGACGGTCTTGGAATTAGTCATAAAC
TACCAGCAACTCTGCATCTACTGGACAAAGTATTATGACTTTAAAAACCCCATTATTGAAAAGTACCTGAGAAGG
CAGCTCACGAAACCCAGGCCTGTGATCCTGGACCCGGCGGACCCTACAGGAAACTTGGGTGGTGGAGACCCAAAG
GGTTGGAGGCAGCTGGCACAAGAGGCTGAGGCCTGGCTGAATTACCCATGCTTTAAGAATTGGGATGGGTCCCCA
GTGAGCTCCTGGATTCTGCTGGCTGAAAGCAACAGTACAGACGATGAGACCGACGATCCCAGGACGTATCAGAAA
TATGGTTACATTGGAACACATGAGTACCCTCATTTCTCTCATAGACCCAGCACGCTCCAGGCAGCATCCACCCCA
CAGGCAGAAGAGGACTGGACCTGCACCATCCTCTGAATGCCAGTGCATCTTGGGGGAAAGGGCTCCAGTGTTATC
TGGACCAGTTCCTTCATTTTCAGGTGGGACTCTTGATCCAGAGAAGACAAAGCTCCTCAGTGAGCTGGTGTATAA
TCCAAGACAGAACCCAAGTCTCCTGACTCCTGGCCTTCTATGCCCTCTATCCTATCATAGATAACATTCTCCACA
GCCTCACTTCATTCCACCTATTCTCTGAAAATATTCCCTGAGAGAGAACAGAGAGATTTAGATAAGAGAATGAAA
TTCCAGCCTTGACTTTCTTCTGTGCACCTGATGGGAGGGTAATGTCTAATGTATTATCAATAACAATAAAAATAA
AGCAAATACCAAAAA
```

FIGURE 45

```
MMDLRNTPAKSLDKFIEDYLLPDTCFRMQIDHAIDIICGFLKERCFRGSSYPVCVSKVVKGGSSGKGTTLRGRSD
ADLVVFLSPLTTFQDQLNRRGEFIQEIRRQLEACQRERALSVKFEVQAPRWGNPRALSFVLSSLQLGEGVEFDVL
PAFDALGQLTGSYKPNPQIYVKLIEECTDLQKEGEFSTCFTELQRDFLKQRPTKLKSLIRLVKHWYQNCKKKLGK
LPPQYALELLTVYAWERGSMKTHFNTAQGFRTVLELVINYQQLCIYWTKYYDFKNPIIEKYLRRQLTKPRPVILD
PADPTGNLGGGDPKGWRQLAQEAEAWLNYPCFKNWDGSPVSSWILLAESNSTDDETDDPRTYQKYGYIGTHEYPH
FSHRPSTLQAASTPQAEEDWTCTIL
```

FIGURE 46

```
GAGGCAGTTCTGTTGCCACTCTCTCTCCTGTCAATGATGGATCTCAGAAATACCCCAGCCAAATCTCTGGACAAG
TTCATTGAAGACTATCTCTTGCCAGACACGTGTTTCCGCATGCAAATCGACCATGCCATTGACATCATCTGTGGG
TTCCTGAAGGAAAGGTGCTTCCGAGGTAGCTCCTACCCTGTGTGTGTGTCCAAGGTGGTAAAGGGTGGCTCCTCA
GGCAAGGGCACCACCCTCAGAGGCCGATCTGACGCTGACCTGGTTGTCTTCCTCAGTCCTCTCACCACTTTTCAG
GATCAGTTAAATCGCCGGGGAGAGTTCATCCAGGAAATTAGGAGACAGCTGGAAGCCTGTCAAAGAGAGAGAGCA
CTTTCCGTGAAGTTTGAGGTCCAGGCTCCACGCTGGGGCAACCCCCGTGCGCTCAGCTTCGTACTGAGTTCGCTC
CAGCTCGGGGAGGGGGTGGAGTTCGATGTGCTGCCTGCCTTTGATGCCCTGGGTCAGTTGACTGGCAGCTATAAA
CCTAACCCCCAAATCTATGTCAAGCTCATCGAGGAGTGCACCGACCTGCAGAAAGAGGGCGAGTTCTCCACCTGC
TTCACAGAACTACAGAGAGACTTCCTGAAGCAGCGCCCCACCAAGCTCAAGAGCCTCATCCGCCTAGTCAAGCAC
TGGTACCAAAATTGTAAGAAGAAGCTTGGGAAGCTGCCACCTCAGTATGCCCTGGAGCTCCTGACGGTCTATGCT
TGGGAGCGAGGGAGCATGAAAACACATTTCAACACAGCCCAAGGATTTCGGACGGTCTTGGAATTAGTCATAAAC
TACCAGCAACTCTGCATCTACTGGACAAAGTATTATGACTTTAAAAACCCCATTATTGAAAAGTACCTGAGAAGG
CAGCTCACGAAACCCAGGCCTGTGATCCTGGACCCGGCGGACCCTACAGGAAACTTGGGTGGTGGAGACCCAAAG
GGTTGGAGGCAGCTGGCACAAGAGGCTGAGGCCTGGCTGAATTACCCATGCTTTAAGAATTGGGATGGGTCCCCA
GTGAGCTCCTGGATTCTGCTGGCTGAAAGCAACAGTACAGACGATGAGACCGACGATCCCAGGACGTATCAGAAA
TATGGTTACATTGGAACACATGAGTACCCTCATTTCTCTCATAGACCCAGCACGCTCCAGGCAGCATCCACCCCA
CAGGCAGAAGAGGACTGGACCTGCACCATCCTCTGAATGCCAGTGCATCTTGGGGGAAAGGGCTCCAGTGTTATC
TGGACCAGTTCCTTCATTTTCAGGTGGGACTCTTGATCCAGAGAAGACAAAGCTCCTCAGTGAGCTGGTGTATAA
TCCAAGACAGAACCCAAGTCTCCTGACTCCTGGCCTTCTATGCCCTCTATCCTATCATAGATAACATTCTCCACA
GCCTCACTTCATTCCACCTATTCTCTGAAAATATTCCCTGAGAGAGAACAGAGAGATTTAGATAAGAGAATGAAA
TTCCAGCCTTGACTTTCTTCTGTGCACCTGATGGGAGGGTAATGTCTAATGTATTATCAATAACAATAAAAATAA
AGCAAATACCAAAAA
```

FIGURE 47

MMDLRNTPAKSLDKFIEDYLLPDTCFRMQIDHAIDIICGFLKERCFRGSSYPVCVSKVVKGGSSGKGTTLRGRSD
ADLVVFLSPLTTFQDQLNRRGEFIQEIRRQLEACQRERALSVKFEVQAPRWGNPRALSFVLSSLQLGEGVEFDVL
PAFDALGQLTGSYKPNPQIYVKLIEECTDLQKEGEFSTCFTELQRDFLKQRPTKLKSLIRLVKHWYQNCKKKLGK
LPPQYALELLTVYAWERGSMKTHFNTAQGFRTVLELVINYQQLCIYWTKYYDFKNPIIEKYLRRQLTKPRPVILD
PADPTGNLGGGDPKGWRQLAQEAEAWLNYPCFKNWDGSPVSSWILLAESNSTDDETDDPRTYQKYGYIGTHEYPH
FSHRPSTLQAASTPQAEEDWTCTIL

FIGURE 48

```
GCAGAGGAGGCGGCGGAACACCCCGGGTTGGTCGGGTTTCCAAGGGCTGACCCGAGCTCCAGCACTTTTTCCGCG
CCTGATTTTTCAGAGCTCTTCAGAAACCAGGCTGCTTTCAGGAACATTGCTGTGGATTCCCAGGGCCTATTCCAC
TAGAAGCAAGATGGCTGAACTCAATACTCATGTGAATGTCAAGGAAAAGATCTATGCAGTTAGATCAGTTGTTCC
CAACAAAAGCAATAATGAAATAGTCCTGGTGCTCCAACAGTTTGATTTTAATGTGGATAAAGCCGTGCAAGCCTT
TGTGGATGGCAGTGCAATTCAAGTTCTAAAAGAATGGAATATGACAGGAAAAAAGAAGAACAATAAAAGAAAAAG
AAGCAAGTCCAAGCAGCATCAAGGCAACAAAGATGCTAAAGACAAGGTGGAGAGGCCTGAGGCAGGGCCCCTGCA
GCCGCAGCCACCACAGATTCAAAACGGCCCCATGAATGGCTGCGAGAAGGACAGCTCGTCCACAGATTCTGCTAA
CGAAAAACCAGCCCTTATCCCTCGTGAGAAAAGATCTCGATACTTGAGGAACCTTCAAAGGCACTTCGTGGGGT
CACAGAAGGCAACAGACTACTGCAACAGAAACTATCCTTAGATGGGAACCCCAAACCTATACATGGAACAACAGA
GAGGTCAGATGGCCTACAGTGGTCAGCTGAGCAGCCTTGTAACCCAAGCAAGCCTAAGGCAAAAACATCTCCTGT
TAAGTCCAATACCCCTGCAGCTCATCTTGAAATAAAGCCAGATGAGTTGGCAAAGAAAAGAGGCCCAAATATTGA
GAAATCAGTGAAGGATTTGCAACGCTGCACCGTTTCTCTAACTAGATATCGCGTCATGATTAAGGAAGAAGTGGA
TAGTTCCGTGAAGAAGATCAAAGCTGCCTTTGCTGAATTACACAACTGCATCATTGACAAAGAAGTTTCATTAAT
GGCAGAAATGGATAAAGTTAAAGAAGAAGCCATGGAAATCCTGACTGCTCGTCAGAAGAAAGCAGAAGAACTAAA
GAGACTCACTAACCTTGCCAGTCAGATGGCAGAGATGCAGCTGGCCGAACTCAGGGCAGAAATTAAGCACTTTGT
CAGCGAGCGTAAATATGACGAGGAGCTCGGGAAAGCTGCCCGGTTTTCCTGTGACATCGAACAGCTGAAGGCCCA
AATCATGCTCTGCGGAGAAATTACACATCCAAAGAACAACTATTCCTCAAGAACTCCCTGCAGCTCCCTGCTGCC
TCTGCTGAATGCGCACGCAGCAACCTCTGGGAAACAGAGTAACTTTTCCCGAAAATCATCCACTCACAATAAGCC
CTCTGAAGGCAAAGCGGCAAACCCCAAAATGGTGAGCAGTCTCCCCAGCACCGCCGACCCCTCTCACCAGACCAT
GCCGGCCAACAAGCAGAATGGATCTTCTAACCAAAGACGGAGATTTAATCCACAGTATCATAACAACAGGCTAAA
TGGGCCTGCCAAGTCGCAGGGCAGTGGGAATGAAGCCGAGCCACTGGGAAAGGGCAACAGCCGCCACGAACACAG
AAGACAGCCGCACAACGGCTTCCGGCCCAAAAACAAAGGCGGTGCCAAAAATCAAGAGGCTTCCTTGGGGATGAA
GACCCCCGAGGCCCCGGCCCATTCTGAAAAGCCCCGGCGAAGGCAGCACGCTGCAGACACCTCGGAGGCCAGGCC
CTTCCGGGGTAGTGTCGGTAGGGTTTCACAGTGCAATCTCTGCCCCACGAGAATAGAAGTTTCCACAGATGCAGC
AGTTCTCTCAGTCCCGGCTGTGACGTTGGTGGCCTGAGCTAGGAGGAAAAAGAGCAGTTTTCACTCAGTTTTGGT
TCCCTGCCCGAGGTGCTGACCCAATTCGCTGCCAAAAGAGTGTCAATCAGAATATACAAATCCCGTATGGTTGTG
TCATCCTCTCTTAATCATTTTTACTAATTCTAATAATCAGCTCTAGCTTGCTTCATAATTTTCATGGCTTTGCTT
GATCTGTTGATGCTTTCTCTCATCAAGACTTTGCAGCATTTTAGCCAGGCAGTATTTACTCATTATTAGGAAAAT
CAAGATGTGGCTGAAGATCAGAGGCTCAGTTAGCAACCTGTGTTGTAGCAGTGATGTCAGTCCATAGATTGTCTT
TAGAGAGTTAATGTTACAAAAAAGAATTCTTAATAATCAGACAAACATGATCTGCTGAGGACACATGCGCTTTTG
TAGAATTTAACATCTGGTGTTTTTCTGAAAAAATATATATACATATATTGCTTTATTTGAAACAAATTAAAATAT
GCTGCATTTGAAAAAAAAAAAAAAAAAAAA
```

FIGURE 49

MAELNTHVNVKEKIYAVRSVVPNKSNNEIVLVLQQFDFNVDKAVQAFVDGSAIQVLKEWNMTGKKKNNKRKRSKS
KQHQGNKDAKDKVERPEAGPLQPQPPQIQNGPMNGCEKDSSSTDSANEKPALIPREKKISILEEPSKALRGVTEG
NRLLQQKLSLDGNPKPIHGTTERSDGLQWSAEQPCNPSKPKAKTSPVKSNTPAAHLEIKPDELAKKRGPNIEKSV
KDLQRCTVSLTRYRVMIKEEVDSSVKKIKAAFAELHNCIIDKEVSLMAEMDKVKEEAMEILTARQKKAEELKRLT
NLASQMAEMQLAELRAEIKHFVSERKYDEELGKAARFSCDIEQLKAQIMLCGEITHPKNNYSSRTPCSSLLPLLN
AHAATSGKQSNFSRKSSTHNKPSEGKAANPKMVSSLPSTADPSHQTMPANKQNGSSNQRRRFNPQYHNNRLNGPA
KSQGSGNEAEPLGKGNSRHEHRRQPHNGFRPKNKGGAKNQEASLGMKTPEAPAHSEKPRRRQHAADTSEARPFRG
SVGRVSQCNLCPTRIEVSTDAAVLSVPAVTLVA

FIGURE 50

```
GGGGGAAGGGAAACAAACAAAAAGGAACCAGAGGCCACTTGTATATATAGGTCTCTTCAGCATTTATTGGTGGCA
GAAGAGGAAGATTTCTGAAGAGTGCAGCTGCCTGAACCGAGCCCTGCCGAACAGCTGAGAATTGCACTGCAACCA
TGAGTGAGAACAATAAGAATTCCTTGGAGAGCAGCCTACGGCAACTAAAATGCCATTTCACCTGGAACTTGATGG
AGGGAGAAAACTCCTTGGATGATTTTGAAGACAAAGTATTTTACCGGACTGAGTTTCAGAATCGTGAATTCAAAG
CCACAATGTGCAACCTACTGGCCTATCTAAAGCACCTCAAAGGGCAAAACGAGGCAGCCCTGGAATGCTTACGTA
AAGCTGAAGAGTTAATCCAGCAAGAGCATGCTGACCAGGCAGAAATCAGAAGTCTGGTCACCTGGGGAAACTATG
CCTGGGTCTACTATCACATGGGCCGACTCTCAGACGTTCAGATTTATGTAGACAAGGTGAAACATGTCTGTGAGA
AGTTTTCCAGTCCCTATAGAATTGAGAGTCCAGAGCTTGACTGTGAGGAAGGGTGGACACGGTTAAAGTGTGGAG
GAAACCAAAATGAAAGAGCGAAGGTGTGCTTTGAAGAGGCTCTGGAAAAGAAGCCAAAGAACCCAGAATTCACCT
CTGGACTGGCAATAGCAAGCTACCGTCTGGACAACTGGCCACCATCTCAGAACGCCATTGACCCTCTGAGGCAAG
CCATTCGGCTGAATCCTGACAACCAGTACCTTAAAGTCCTCCTGGCTCTGAAGCTTCATAAGATGCGTGAAGAAG
GTGAAGAGGAAGGTGAAGGAGAGAAGTTAGTTGAAGAAGCCTTGGAGAAAGCCCCAGGTGTAACAGATGTACTTC
GCAGTGCAGCCAAGTTTTATCGAAGAAAGATGAGCCAGACAAAGCGATTGAACTGCTTAAAAAGGCTTTAGAAT
ACATACCAAACAATGCCTACCTGCATTGCCAAATTGGGTGCTGCTATAGGGCAAAAGTCTTCCAAGTAATGAATC
TAAGAGAGAATGGAATGTATGGGAAAAGAAAGTTACTGGAACTAATAGGACACGCTGTGGCTCATCTGAAGAAAG
CTGATGAGGCCAATGATAATCTCTTCCGTGTCTGTTCCATTCTTGCCAGCCTCCATGCTCTAGCAGATCAGTATG
AAGAAGCAGAGTATTACTTCCAAAAGGAATTCAGTAAAGAGCTTACTCCTGTAGCGAAACAACTGCTCCATCTGC
GGTATGGCAACTTTCAGCTGTACCAAATGAAGTGTGAAGACAAGGCCATCCACCACTTTATAGAGGGTGTAAAAA
TAAACCAGAAATCAAGGGAGAAAGAAAAGATGAAAGACAAACTGCAAAAAATTGCCAAAATGCGACTTTCTAAAA
ATGGAGCAGATTCTGAGGCTTTGCATGTCTTGGCATTCCTTCAGGAGCTGAATGAAAAAATGCAACAAGCAGATG
AAGACTCTGAGAGGGGTTTGGAGTCTGGAAGCCTCATCCCTTCAGCATCAAGCTGGAATGGGGAATGAAGAATAG
AGATGTGGTGCCCACTAGGCTACTGCTGAAAGGGAGCTGAAATTCCTCCACCAAGTTGGTATTCAAAATATGTAA
TGACTGGTATGGCAAAAGATTGGACTAAGACACTGGCCATACCACTGGACAGGGTTATGTTAACACCTGAATTGC
TGGGTCTTGAGAGAGCCCAAGGAGTTCTGGGAGAGGGACCAGATTGGGGGGTAGGTCCACGGGCTTGGTGATAGA
ATTATTTCTCGATTGACTTCTTGAGTGCAATTTGAACTGTAACATTTGCTTAGTCACCTTTAGTGGAGTAATCTA
CTGGGCTTGTTTCTATATTTATATAAAGCAGCCAAATCCTTCATGTAATATTGAAGTCCATTTTTGCAATGTTGT
TCCATACTTGGAGTCATTTTGCATCCCATAGAGGTTAGTCCTGCATAGCCAGTAATGTGCTAAGTTCATCCAAAA
GCTGGCGGACCAAAGTCTAAATAGGGCTCAGTATCCCCCATCGCTTATCTCTGCCTCCTTCCTCCTCCTTCCCAG
TCTATCATCAACCTTGAGTATTCTACACAATGTGAATTCAAGTGCCTGATTAATTGAGGTGGCAACATAGTTTGA
GACGAGGGCAGAGAACAGGAAGATACATAGCTAGAAGCGACGGGTACAAAAAGCAATGTGTACAAGAAGACTTTC
AGCAAGTATACAGAGAGTTCACCTCTACTCTGCCCTCCTCATAGTCATAATGTAGCAAGTAAAGAATGAGAATGG
ATTCTGTACAATACACTAGAAACCAACATAATGTATTTCTTTAAAACCTGTGTGAAAAAATAAATGTTCCACCAG
TAGGGATAGGGGAAAAGTAACCAAAAGAGAGAAAGAGAAAGGAATGCTGGTTTATCTTTGTAGATTGTAATCGAA
TGGAGAAATTTGCAGTATTTTAGCCACTATTAGGAATTTTTTTTTTTGTAAAATGAAGACTGAACTCTGTTCAA
ATGCTTTCATGAACCTGGTTTGAGACGGTAGGAAAGCAACAAAACGTGGGAACCTGGTGACTAAGGGCCTGGTGC
AAGGACTTGGGAAATGTCATTGATAATAGATGGTGGGTTTTCCCCCCTTTAGAAATGTTGGATATTAAGTGATA
TAAACACTTCTTTTAACTCCGAAAATCTTCTGAGAAATCACAAAATTCACGGTATGCTTGGAACGATTGAGATTT
TCTAGGTAGATGCTGAATAGCCTAGACATCAAAGTTGGTGTGAACCAAAATAGAGTCAGCTGACCCAGCATCAGC
CACACTCTGGGTTGGAAAATGTTTGCCTGTTGGAATTAATTTAAGCTTAAGTATATATCAACATTATTTTATTGT
GCAATTAAAACAATACAAATTCATGGTTTTTTAAAGTTAAAAATTCTAACCACTGTAACAACAGTTTTTGTGTTA
TTTTCTGTATTAAACATCTTGTTGCACGCATTTGAGGTCATCAGGGTGCAAAATTTGTATTCCTGAAAATGTCAT
ATATTTCATTAATAAATAACCTAAATATGATAAAACATAAAGCAGTGTTCTGGTTCATCTGGAATTTTGCTGTA
CTTTAAATCTTTCAGACTCAGCTACTGATAAATGAAACGTTACACAGGTGTGAACCAAATCCAAATAACCTCGAC
TGGTCTACTATCATAATCACCTGAACAGAACAAAACTTTTTCCTCAGCTTTAAGAGTCCAGGGCTTCGGATAACA
GCTGCCATCTGCCACCTGCTACCATTGACCTACGTGAACACAGACATTCTGTCTCCACCTTGATGGTGGGTGGGC
TGCTCCCCTTTTCTTTGTTAAATTTTGTGCTTTCATCACATTTTCTCTATTCTGACCTCTGTTATGAGAAATAAA
AGTCACTGATTCCATTTT
```

FIGURE 51

GEGKQTKRNQRPLVYIGLFSIYWWQKRKISEECSCLNRALPNSENCTATMSENNKNSLESSLRQLKCHFTWNLME
GENSLDDFEDKVFYRTEFQNREFKATMCNLLAYLKHLKGQNEAALECLRKAEELIQQEHADQAEIRSLVTWGNYA
WVYYHMGRLSDVQIYVDKVKHVCEKFSSPYRIESPELDCEEGWTRLKCGGNQNERAKVCFEKALEKKPKNPEFTS
GLAIASYRLDNWPPSQNAIDPLRQAIRLNPDNQYLKVLLALKLHKMREEGEEEGEGEKLVEEALEKAPGVTDVLR
SAAKFYRRKDEPDKAIELLKKALEYIPNNAYLHCQIGCCYRAKVFQVMNLRENGMYGKRKLLELIGHAVAHLKKA
DEANDNLFRVCSILASLHALADQYEEAEYYFQKEFSKELTPVAKQLLHLRYGNFQLYQMKCEDKAIHHFIEGVKI
NQKSREKEKMKDKLQKIAKMRLSKNGADSEALHVLAFLQELNEKMQQADEDSERGLESGSLIPSASSWNGE

FIGURE 52A

```
GCCCTGCTTCCCCTTGCACCTGCGCCGGGCGGCATGGACTTGTACAGCACCCCGGCCGCTGCGCTGGACAGGTT
CGTGGCCAGAAGGCTGCAGCCGCGGAAGGAGTTCGTAGAGAAGGCGCGGCGCGCTCTGGGCGCCCTGGCCGCTGC
CCTGAGGGAGCGCGGGGCCGCCTCGGTGCTGCTGCCCCGCGGGTGCTGAAAACTGTCAAGGGAGGCTCCTCGGG
CCGGGGCACAGCTCTCAAGGGTGGCTGTGATTCTGAACTTGTCATCTTCCTCGACTGCTTCAAGAGCTATGTGGA
CCAGAGGGCCCGCCGTGCAGAGATCCTCAGTGAGATGCGGGCATCGCTGGAATCCTGGTGGCAGAACCCAGTCCC
TGGTCTGAGACTCACGTTTCCTGAGCAGAGCGTGCCTGGGGCCCTGCAGTTCCGCCTGACATCCGTAGATCTTGA
GGACTGGATGGATGTTAGCCTGGTGCCTGCCTTCAATGTCCTGGGTCAGGCCGGCTCCGCGGTCAAACCCAAGCC
ACAAGTCTACTCTACCCTCCTCAACAGTGGCTGCCAAGGGGCGAGCATGCGGCCTGCTTCACAGAGCTGCGGAG
GAACTTTGTGAACATTCGCCCAGCCAAGTTGAAGAACCTAATCTTGCTGGTGAAGCACTGGTACCACCAGGTGTG
CCTACAGGGGTTGTGGAAGGAGACGCTGCCCCCGGTCTATGCCCTGGAATTGCTGACCATCTTCGCCTGGGAGCA
GGGCTGTAAGAAGGATGCTTTCAGCCTAGGCGAAGGCCTCCGAACTGTCCTGGGCCTGATCCAACAGCATCAGCA
CCTGTGTGTTTTCTGGACTGTCAACTATGGCTTCGAGGACCCTGCAGTTGGGCAGTTCTTGCAGCGGCACGTTAA
GAGACCCAGGCCTGTGATCCTGGACCCAGCTGACCCCACATGGGACCTGGGGAATGGGGCAGCCTGGCACTGGGA
TTTGCATGCCCAGGAGGCAGCATCCTGCTATGACCACCCATGCTTTCTGAGGGGGATGGGGGACCCAGTGCAGTC
TTGGAAGGGGCCGGGCCTTCCACGTGCTGGATGCTCAGGTTTGGGCCACCCCATCCAGCTAGACCCTAACCAGAA
GACCCCTGAAAACAGCAAGAGCCTCAATGCTGTGTACCCAAGAGCAGGGAGCAAACCTCCCTCATGCCCAGCTCC
TGGCCCCACTGCGGAGCCAGCATCGTACCCCTCTGTGCCGGGAATGGCCTTGGACCTGTCTCAGATCCCCACCAA
GGAGCTGGACCGCTTCATCCAGGACCACCTGAAGCCGAGCCCCCAGTTCCAGGAGCAGGTGAAAAAGGCCATCGA
CATCATCTTGCGCTGCCTCCATGAGAACTGTGTTCACAAGGCCTCAAGAGTCAGTAAAGGGGGCTCATTTGGCCG
GGGCACAGACCTAAGGGATGGCTGTGATGTTGAACTCATCATCTTCCTCAACTGCTTCACGGACTACAAGGACCA
GGGGCCCCGCCGCGCAGAGATCCTTGATGAGATGCGAGCGCACGTAGAATCCTGGTGGCAGGACCAGGTGCCCAG
CCTGAGCCTTCAGTTTCCTGAGCAGAATGTGCCTGAGGCTCTGCAGTTCCAGCTGGTGTCCACAGCCCTGAAGAG
CTGGACGGATGTTAGCCTGCTGCCTGCCTTCGATGCTGTGGGGCAGCTCAGTTCTGGCACCAAACCAAATCCCCA
GGTCTACTCGAGGCTCCTCACCAGTGGCTGCCAGGAGGGCGAGCATAAGGCCTGCTTCGCAGAGCTGCGGAGGAA
CTTCATGAACATTCGCCCTGTCAAGCTGAAGAACCTGATTCTGCTGGTGAAGCACTGGTACCGCCAGGTTGCGGC
TCAGAACAAAGGAAAAGGACCAGCCCCTGCCTCTCTGCCCCCAGCCTATGCCCTGGAGCTCCTCACCATCTTTGC
CTGGGAGCAGGGCTGCAGGCAGGATTGTTTCAACATGGCCCAAGGCTTCCGGACGGTGCTGGGGCTCGTGCAACA
GCATCAGCAGCTCTGTGTCTACTGGACGGTCAACTATAGCACTGAGGACCCAGCCATGAGAATGCACCTTCTTGG
CCAGCTTCGAAAACCCAGACCCCTGGTCCTGGACCCCGCTGATCCCACCTGGAACGTGGGCCACGGTAGCTGGGA
GCTGTTGGCCCAGGAAGCAGCAGCGCTGGGGATGCAGGCCTGCTTTCTGAGTAGAGACGGGACATCTGTGCAGCC
CTGGGATGTGATGCCAGCCCTCCTTTACCAAACCCCAGCTGGGGACCTTGACAAGTTCATCAGTGAATTTCTCCA
GCCCAACCGCCAGTTCCTGGCCCAGGTGAACAAGGCCGTTGATACCATCTGTTCATTTTTGAAGGAAAACTGCTT
CCGGAATTCTCCCATCAAAGTGATCAAGGTGGTCAAGGGTGGCTCTTCAGCCAAAGGCACAGCTCTGCGAGGCCG
CTCAGATGCCGACCTCGTGGTGTTCCTCAGCTGCTTCAGCCAGTTCACTGAGCAGGGCAACAAGCGGGCCGAGAT
CATCTCCGAGATCCGAGCCCAGCTGGAGGCATGTCAACAGGAGCGGCAGTTCGAGGTCAAGTTTGAAGTCTCCAA
ATGGGAGAATCCCCGCGTGCTGAGCTTCTCACTGACATCCCAGACGATGCTGGACCAGAGTGTGGACTTTGATGT
GCTGCCAGCCTTTGACGCCCTAGGCCAGCTGGTCTCTGGCTCCAGGCCCAGCTCTCAAGTCTACGTCGACCTCAT
CCACAGCTACAGCAATGCGGGCGAGTACTCCACCTGCTTCACAGAGCTACAACGGGACTTCATCATCTCTCGCCC
TACCAAGCTGAAGAGCCTGATCCGGCTGGTGAAGCACTGGTACCAGCAGTGTACCAAGATCTCCAAGGGGAGAGG
CTCCCTACCCCCACAGCACGGGCTGGAACTCCTGACTGTGTATGCCTGGGAGCAGGGCGGGAAGGACTCCCAGTT
CAACATGGCTGAGGGCTTCCGCACGGTCCTGGAGCTGGTCACCCAGTACCGCCAGCTCTGTATCTACTGGACCAT
CAACTACAACGCCAAGGACAAGACTGTTGGAGACTTCCTGAAACAGCAGCTTCGAAGCCCAGGCCTATCATCCT
GGATCCGGCTGACCCGACAGGCAACCTGGGCCACAATGCCCGCTGGGACCTGCTGGCCAAGGAAGCTGCAGCCTG
CACATCTGCCCTGTGCTGCATGGGACGGAATGGCATCCCCATCCAGCCATGGCCAGTGAAGGCTGCTGTGTGAAG
TTGAGAAAATCAGCGGTCCTACTGGATGAAGAGAAGATGGACACCAGCCCTCAGCATGAGGAAATTCAGGGTCCC
CTACCAGATGAGAGAGATTGTGTACATGTGTGTGTGAGCACATGTGTGCATGTGTGTGCACACGTGTGCATGTGT
GTGTTTAGTGAATCTGCTCTCCCAGCTCACACACTCCCCTGCCTCCCATGGCTTACACACTAGGATCCAGACTC
CATGGTTTGACACCAGCCTGCGTTTGCAGCTTCTCTGTCACTTCCATGACTCTATCCTCATACCACCACTGCTGC
```

FIGURE 52B

```
TTCCCACCCAGCTGAGAATGCCCCCTCCTCCCTGACTCCTCTCTGCCCATGCAAATTAGCTCACATCTTTCCTCC
TGCTGCAATCCATCCCTTCCTCCCATTGGCCTCTCCTTGCCAAATCTAAATACTTTATATAGGGATGGCAGAGAG
TTCCCATCTCATCTGTCAGCCACAGTCATTTGGTACTGGCTACCTGGAGCCTTATCTTCTGAAGGGTTTTAAAGA
ATGGCCAATTAGCTGAGAAGAATTATCTAATCAATTAGTGATGTCTGCCATGGATGCAGTAGAGGAAAGTGGTGG
TACAAGTGCCATGATTGATTAGCAATGTCTGCACTGGATATGGAAAAAAGAAGGTGCTTGCAGGTTTACAGTGTA
TATGTGGGCTATTGAAGAGCCCTCTGAGCTCGGTTGCTAGCAGGAGAGCATGCCCATATTGGCTTACTTTGTCTG
CCACAGACACAGACAGAGGGAGTTGGGACATGCATGCTATGGGGACCCTCTTGTTGGACACCTAATTGGATGCCT
CTTCATGAGAGGCCTCCTTTTCTTCACCTTTTATGCTGCACTCCTCCCCTAGTTTACACATCTTGATGCTGTGGC
TCAGTTTGCCTTCCTGAATTTTTATTGGGTCCCTGTTTTCTCTCCTAACATGCTGAGATTCTGCATCCCCACAGC
CTAAACTGAGCCAGTGGCCAAACAACCGTGCTCAGCCTGTTTCTCTCTGCCCTCTAGAGCAAGGCCCACCAGGTC
CATCCAGGAGGCTCTCCTGACCTCAAGTCCAACAACAGTGTCCACACTAGTCAAGGTTCAGCCCAGAAAACAGAA
AGCACTCTAGGAATCTTAGGCAGAAAGGGATTTTATCTAAATCACTGGAAAGGCTGGAGGAGCAGAAGGCAGAGG
CCACCACTGGACTATTGGTTTCAATATTAGACCACTGTAGCCGAATCAGAGGCCAGAGAGCAGCCACTGCTACTG
CTAATGCCACCACTACCCCTGCCATCACTGCCCCACATGGACAAAACTGGAGTCGAGACCTAGGTTAGATTCCTG
CAACCACAAACATCCATCAGGGATGGCCAGCTGCCAGAGCTGCGGGAAGACGGATCCCACCTCCCTTTCTTAGCA
GAATCTAAATTACAGCCAGACCTCTGGCTGCAGAGGAGTCTGAGACATGTATGATTGAATGGGTGCCAAGTGCCA
GGGGGCGGAGTCCCCAGCAGATGCATCCTGGCCATCTGTTGCGTGGATGAGGGAGTGGGTCTATCTCAGAGGAAG
GAACAGGAAACAAAGAAAGGAAGCCACTGAACATCCCTTCTCTGCTCCACAGGAGTGTCTTAGACAGCCTGACTC
TCCACAAACCACTGTTAAAACTTACCTGCTAGGAATGCTAGATTGAATGGGATGGGAAGAGCCTTCCCTCATTAT
TGTCATTCTTGGAGAGAGGTGAGCAACCAAGGGAAGCTCCTCTGATTCACCTAGAACCTGTTCTCTGCCGTCTTT
GGCTCAGCCTACAGAGACTAGAGTAGGTGAAGGGACAGAGGACAGGGCTTCTAATACCTGTGCCATATTGACAGC
CTCCATCCCTGTCCCCCATCTTGGTGCTGAACCAACGCTAAGGGCACCTTCTTAGACTCACCTCATCGATACTGC
CTGGTAATCCAAAGCTAGAACTCTCAGGACCCCAAACTCCACCTCTTGGATTGGCCCTGGCTGCTGCCACACACA
TATCCAAGAGCTCAGGGCCAGTTCTGGTGGGCAGCAGAGACCTGCTCTGCCAAGTTGTCCAGCAGCAGAGTGGCC
CTGGCCTGGGCATCACAAGCCAGTGATGCTCCTGGGAAGACCAGGTGGCAGGTCGCAGTTGGGTACCTTCCATTC
CCACCACACAGACTCTGGGCCTCCCCGCAAAATGGCTCCAGAATTAGAGTAATTATGAGATGGTGGGAACCAGAG
CAACTCAGGTGCATGATACAAGGAGAGGTTGTCATCTGGGTAGGGCAGAGAGGAGGGCTTGCTCATCTGAACAGG
GGTGTATTTCATTCCAGGCCCTCAGTCTTTGGCAATGGCCACCCTGGTGTTGGCATATTGGCCCCACTGTAACTT
TTGGGGGCTTCCCGGTCTAGCCACACCCTCGGATGGAAAGACTTGACTGCATAAAGATGTCAGTTCTCCCTGAGT
TGATTGATAGGCTTAATGGTCACCCTAAAAACACCCACATATGCTTTTCGATGGAACCAGATAAGTTGACGCTAA
AGTTCTTATGGAAAAATACACACGCAATAGCTAGGAAAACACAGGGAAAGAAGAGTTCTGAGCAGGGCCTAGTCT
TAGCCAATATTAAAACATACTATGAAGCCTCTGATACTTAAACAGCATGGCGCTGGTACGTAAATAGACCAATGC
AGTTAGGTGGCTCTTTCCAAGACTCTGGGGAAAAAAGTAGTAAAAAGCTAAATGCAATCAATCAGCAATTGAAAG
CTAAGTGAGAGAGCCAGAGGGCCTCCTTGGTGGTAAAAGAGGGTTGCATTTCTTGCAGCCAGAAGGCAGAGAAAG
TGAAGACCAAGTCCAGAACTGAATCCTAAGAAATGCAGGACTGCAAAGAAATTGGTGTGTGTGTGTGTGTGTGTG
TGTGTGTGTTTAATTTTTAAAAAGTTTTTATTCGGAATCCGCG
```

FIGURE 53

MDLYSTPAAALDRFVARRLQPRKEFVEKARRALGALAAALRERGGRLGAAAPRVLKTVKGGSSGRGTALKGGCDS
ELVIFLDCFKSYVDQRARRAEILSEMRASLESWWQNPVPGLRLTFPEQSVPGALQFRLTSVDLEDWMDVSLVPAF
NVLGQAGSAVKPKPQVYSTLLNSGCQGGEHAACFTELRRNFVNIRPAKLKNLILLVKHWYHQVCLQGLWKETLPP
VYALELLTIFAWEQGCKKDAFSLGEGLRTVLGLIQQHQHLCVFWTVNYGFEDPAVGQFLQRHVKRPRPVILDPAD
PTWDLGNGAAWHWDLHAQEAASCYDHPCFLRGMGDPVQSWKGPGLPRAGCSGLGHPIQLDPNQKTPENSKSLNAV
YPRAGSKPPSCPAPGPTAEPASYPSVPGMALDLSQIPTKELDRFIQDHLKPSPQFQEQVKKAIDIILRCLHENCV
HKASRVSKGGSFGRGTDLRDGCDVELIIFLNCFTDYKDQGPRRAEILDEMRAHVESWWQDQVPSLSLQFPEQNVP
EALQFQLVSTALKSWTDVSLLPAFDAVGQLSSGTKPNPQVYSRLLTSGCQEGEHKACFAELRRNFMNIRPVKLKN
LILLVKHWYRQVAAQNKGKGPAPASLPPAYALELLTIFAWEQGCRQDCFNMAQGFRTVLGLVQQHQQLCVYWTVN
YSTEDPAMRMHLLGQLRKPRPLVLDPADPTWNVGHGSWELLAQEAAALGMQACFLSRDGTSVQPWDVMPALLYQT
PAGDLDKFISEFLQPNRQFLAQVNKAVDTICSFLKENCFRNSPIKVIKVVKGGSSAKGTALRGRSDADLVVFLSC
FSQFTEQGNKRAEIISEIRAQLEACQQERQFEVKFEVSKWENPRVLSFSLTSQTMLDQSVDFDVLPAFDALGQLV
SGSRPSSQVYVDLIHSYSNAGEYSTCFTELQRDFIISRPTKLKSLIRLVKHWYQQCTKISKGRGSLPPQHGLELL
TVYAWEQGGKDSQFNMAEGFRTVLELVTQYRQLCIYWTINYNAKDKTVGDFLKQQLQKPRPIILDPADPTGNLGH
NARWDLLAKEAAACTSALCCMGRNGIPIQPWPVKAAV

FIGURE 54

```
GGCACCGATTCGGGGCCTGCCCGGACTTCGCCGCACGCTGCAGAACCTCGCCCAGCGCCCACCATGCCCCGGCAG
CTCAGCGCGGCGGCCGCGCTCTTCGCGTCCCTGGCCGTAATTTTGCACGATGGCAGTCAAATGAGAGCAAAAGCA
TTTCCAGAAACCAGAGATTATTCTCAACCTACTGCAGCAGCAACAGTACAGGACATAAAAAAACCTGTCCAGCAA
CCAGCTAAGCAAGCACCTCACCAAACTTTAGCAGCAAGATTCATGGATGGTCATATCACCTTTCAAACAGCGGCC
ACAGTAAAAATTCCAACAACTACCCCAGCAACTACAAAAAACACTGCAACCACCAGCCCAATTACCTACACCCTG
GTCACAACCCAGGCCACACCCAACAACTCACACACAGCTCCTCCAGTTACTGAAGTTACAGTCGGCCCTAGCTTA
GCCCCTTATTCACTGCCACCCACCATCACCCCACCAGCTCATACAGCTGGAACCAGTTCATCAACCGTCAGCCAC
ACAACTGGGAACACCACTCAACCCAGTAACCAGACCACCCTTCCAGCAACTTTATCGATAGCACTGCACAAAAGC
ACAACCGGTCAGAAGCCTGATCAACCCACCCATGCCCCAGGAACAACGGCAGCTGCCCACAATACCACCCGCACA
GCTGCACCTGCCTCCACGGTTCCTGGGCCCACCCTTGCACCTCAGCCATCGTCAGTCAAGACTGGAATTTATCAG
GTTCTAAACGGAAGCAGACTCTGTATAAAGCAGAGATGGGGATACAGCTGATTGTTCAAGACAAGGAGTCGGTT
TTTTCACCTCGGAGATACTTCAACATCGACCCCAACGCAACGCAAGCCTCTGGGAACTGTGGCACCCGAAAATCC
AACCTTCTGTTGAATTTTCAGGGCGGATTTGTGAATCTCACATTTACCAAGGATGAAGAATCATATTATATCAGT
GAAGTGGGAGCCTATTTGACCGTCTCAGATCCAGAGACAGTTTACCAAGGAATCAAACATGCGGTGGTGATGTTC
CAGACAGCAGTCGGGCATTCCTTCAAGTGCGTGAGTGAACAGAGCCTCCAGTTGTCAGCCCACCTGCAGGTGAAA
ACAACCGATGTCCAACTTCAAGCCTTTGATTTGAAGATGACCACTTTGGAAATGTGGATGAGTGCTCGTCTGAC
TACACAATTGTGCTTCCTGTGATTGGGGCCATCGTGGTTGGTCTCTGCCTTATGGGTATGGGTGTCTATAAAATC
CGCCTAAGGTGTCAATCATCTGGATACCAGAGAATCTAATTGTTGCCCGGGGGGAATGAAAATAATGGAATTTAG
AGAACTCTTTCATCCCTTCCAGGATGGATGTTGGGAAATTCCCTCAGAGTGTGGGTCCTTCAAACAATGTAAACC
ACCATCTTCTATTCAAATGAAGTGAGTCATGTGTGATTTAAGTTCAGGCAGCACATCAATTTCTAAATACTTTTT
GTTTATTTTATGAAAGATATAGTGAGCTGTTTATTTTCTAGTTTCCTTTAGAATATTTTAGCCACTCAAAGTCAA
CATTTGAGATATGTTGAATTAACATAATATATGTAAAGTAGAATAAGCCTTCAAATTATAAACCAAGGGTCAATT
GTAACTAATACTACTGTGTGTGCATTGAAGATTTTATTTTACCCTTGATCTTAACAAAGCCTTTGCTTTGTTATC
AAATGGACTTTCAGTGCTTTTACTATCTGTGTTTATGGTTTCATGTAACATACATATTCCTGGTGTAGCACTTA
ACTCCTTTTCCACTTTAAATTTGTTTTTGTTTTTGAGACGGAGTTTCACTCTTGTCACCCAGGCTGGAGTACAG
TGGCACGATCTCGGCTTATGGCAACCTCCGCCTCCCGGGTTCAAGTGATTCTCCTGCTTCAGCTTCCCGAGTAGC
TGGGATTACAGGCACACACTACCACGCCTGGCTAATTTTTGTATTTTTATTATAGACGGGTTTCACCATGTTGGC
CAGACTGGTCTTGAACTCTTGACCTCAGGTGATCCACCCACCTCAGCCTCCCAAAGTGCTGGGATTACAGGCATG
AGCCATTGCGCCCGGCCTTAAATGTTTTTTTTAATCATCAAAAAGAAGAACATATCTCAGGTTGTCTAAGTGTTT
TTATGTAAAACCAACAAAAAGAACAAATCAGCTTATATTTTTATCTTGATGACTCCTGCTCCAGAATTGCTAGA
CTAAGAATTAGGTGGCTACAGATGGTAGAACTAAACAATAAGCAAGAGACAATAATAATGGCCCTTAATTATTAA
CAAAGTGCCAGAGTCTAGGCTAAGCACTTTATCTATATCTCATTTCATTCTCACAACTTATAAGTGAATGAGTAA
ACTGAGACTTAAGGGAACTGAATCACTTAAATGTCACCTGGCTAACTGATGGCAGAGCCAGAGCTTGAATTCATG
TTGGTCTGACATCAAGGTCTTTGGTCTTCTCCCTACACCAAGTTACCTACAAGAACAATGACACCACACTCTGCC
TGAAGGCTCACACCTCATACCAGCATACGCTCACCTTACAGGGAAATGGGTTTATCCAGGATCATGAGACATTAG
GGTAGATGAAAGGAGAGCTTTGCAGATAACAAAATAGCCTATCCTTAATAAATCCTCCACTCTCTGGAAGGAGAC
TGAGGGGCTTTGTAAAACATTAGTCAGTTGCTCATTTTTATGGGATTGCTTAGCTGGGCTGTAAAGATGAAGGCA
TCAAATAAACTCAAAGTATTTTTAAATTTTTTTGATAATAGAGAAACTTCGCTAACCAACTGTTCTTTCTTGAGT
GTATAGCCCCATCTTGTGGTAACTTGCTGCTTCTGCACTTCATATCCATATTTCCTATTGTTCACTTTATTCTGT
AGAGCAGCCTGCCAAGAATTTTATTTCTGCTGTTTTTTTGCTGCTAAAGAAAGGAACTAAGTCAGGATGTTAAC
AGAAAAGTCCACATAACCCTAGAATTCTTAGTCAAGGAATAATTCAAGTCAGCCTAGAGACCATGTTGACTTTCC
TCATGTGTTTCCTTATGACTCAGTAAGTTGGCAAGGTCCTGACTTTAGTCTTAATAAAACATTGAATTGTAGTAA
AGGTTTTTGCAATAAAAACTTACTTTGG
```

FIGURE 55

MPRQLSAAAALFASLAVILHDGSQMRAKAFPETRDYSQPTAAATVQDIKKPVQQPAKQAPHQTLAARFMDGHITF
QTAATVKIPTTTPATTKNTATTSPITYTLVTTQATPNNSHTAPPVTEVTVGPSLAPYSLPPTITPPAHTAGTSSS
TVSHTTGNTTQPSNQTTLPATLSIALHKSTTGQKPDQPTHAPGTTAAAHNTTRTAAPASTVPGPTLAPQPSSVKT
GIYQVLNGSRLCIKAEMGIQLIVQDKESVFSPRRYFNIDPNATQASGNCGTRKSNLLLNFQGGFVNLTFTKDEES
YYISEVGAYLTVSDPETVYQGIKHAVVMFQTAVGHSFKCVSEQSLQLSAHLQVKTTDVQLQAFDFEDDHFGNVDE
CSSDYTIVLPVIGAIVVGLCLMGMGVYKIRLRCQSSGYQRI

FIGURE 56

ACAGAGATGGCACTGATGCAGGAACTGTATAGCACACCAGCCTCCAGGCTGGACTCCTTCGTGGCTCAGTGGCTG
CAGCCCCACCGGGAGTGGAAGGAAGAGGTGCTAGACGCTGTGCGGACCGTGGAGGAGTTTCTGAGGCAGGAGCAT
TTCCAGGGGAAGCGTGGGCTGGACCAGGATGTGCGGGTGCTGAAGGTAGTCAAGGTGGGCTCCTTCGGGAATGGC
ACGGTTCTCAGGAGCACCAGAGAGGTGGAGCTGGTGGCGTTTCTGAGCTGTTTCCACAGCTTCCAGGAGGCAGCC
AAGCATCACAAAGATGTTCTGAGGCTGATATGGAAAACCATGTGGCAAAGCCAGGACCTGCTGGACCTCGGGCTC
GAGGACCTGAGGATGGAGCAGAGAGTCCCCGATGCTCTTGTCTTCACCATCCAGACCAGGGGGACTGCGGAGCCC
ATCACGGTCACCATTGTGCCTGCCTACAGAGCCCTGGGGCCTTCTCTTCCCAACTCCCAGCCACCCCCTGAGGTC
TATGTGAGCCTGATCAAGGCCTGCGGTGGTCCTGGAAATTTCTGCCCATCCTTCAGCGAGCTGCAGAGAAATTTC
GTGAAACATCGGCCAACTAAGCTGAAGAGCCTCCTGCGCCTGGTGAAACACTGGTACCAGCAGTATGTGAAAGCC
AGGTCCCCCAGAGCCAATCTGCCCCCTCTCTATGCTCTTGAACTTCTAACCATCTATGCCTGGGAAATGGGTACT
GAAGAAGACGAGAATTTCATGTTGGACGAAGGCTTCACCACTGTGATGGACCTGCTCCTGGAGTATGAAGTCATC
TGTATCTACTGGACCAAGTACTACACACTCCACAATGCAATCATTGAGGATTGTGTCAGAAAACAGCTCAAAAAA
GAGAGGCCCATCATCCTGGATCCGGCCGACCCCACCCTCAACGTGGCAGAAGGGTACAGATGGGACATCGTTGCT
CAGAGGGCCTCCCAGTGCCTGAAACAGGACTGTTGCTATGACAACAGGGAGAACCCCATCTCCAGCTGGAACGTG
AAGAGGGCACGAGACATCCACTTGACAGTGGAGCAGAGGGGTTACCCAGATTTCAACCTCATCGTGAACCCTTAT
GAGCCCATAAGGAAGGTTAAAGAGAAAATCCGGAGGACCAGGGGCTACTCTGGCCTGCAGCGTCTGTCCTTCCAG
GTTCCTGGCAGTGAGAGGCAGCTTCTCAGCAGCAGGTGCTCCTTAGCCAAATATGGGATCTTCTCCCACACTCAC
ATCTATCTGCTGGAGACCATCCCCTCCGAGATCCAGGTCTTCGTGAAGAATCCTGATGGTGGGAGCTACGCCTAT
GCCATCAACCCCAACAGCTTCATCCTGGGTCTGAAGCAGCAGATTGAAGACCAGCAGGGGCTTCCTAAAAAGCAG
CAGCAGCTGGAATTCCAAGGCCAAGTCCTGCAGGACTGGTTGGGTCTGGGGATCTATGGCATCCAAGACAGTGAC
ACTCTCATCCTCTCGAAGAAGAAAGGAGAGGCTCTGTTTCCAGCCAGTTAGTTTCTCTGGGAGACTTCTCTGTA
CATTTCTGCCATGTACTCCAGAACTCATCCTGTCAATCACTCTGTCCCATTGTCTACTGGGAAGGTCCCAGGTCT
TCACCAGTTTTACAATGAGTTATCCCAGGCCAGACGTGGTAGCTCACACCTGTAATCCCAGAACTTTGGGAGGCC
GAGGTGGGAGGAGCGCTTGAGCCGAGGAGTTCAAGACCAGCCTGGGTATCATAGGGAGACCCCGTCTCTACAAAA
TAAAAAAATAATTCACTGGG

FIGURE 57

MALMQELYSTPASRLDSFVAQWLQPHREWKEEVLDAVRTVEEFLRQEHFQGKRGLDQDVRVLKVVKVGSFGNGTV
LRSTREVELVAFLSCFHSFQEAAKHHKDVLRLIWKTMWQSQDLLDLGLEDLRMEQRVPDALVFTIQTRGTAEPIT
VTIVPAYRALGPSLPNSQPPPEVYVSLIKACGGPGNFCPSFSELQRNFVKHRPTKLKSLLRLVKHWYQQYVKARS
PRANLPPLYALELLTIYAWEMGTEEDENFMLDEGFTTVMDLLLEYEVICIYWTKYYTLHNAIIEDCVRKQLKKER
PIILDPADPTLNVAEGYRWDIVAQRASQCLKQDCCYDNRENPISSWNVKRARDIHLTVEQRGYPDFNLIVNPYEP
IRKVKEKIRRTRGYSGLQRLSFQVPGSERQLLSSRCSLAKYGIFSHTHIYLLETIPSEIQVFVKNPDGGSYAYAI
NPNSFILGLKQQIEDQQGLPKKQQQLEFQGQVLQDWLGLGIYGIQDSDTLILSKKKGEALFPAS

FIGURE 58

AGCTGAAGTTGAGGATCTCTTACTCTCTAAGCCACGGAATTAACCCGAGCAGGCATGGAGGCCTCTGCTCTCACC
TCATCAGCAGTGACCAGTGTGGCCAAAGTGGTCAGGGTGGCCTCTGGCTCTGCCGTAGTTTTGCCCCTGGCCAGG
ATTGCTACAGTTGTGATTGGAGGAGTTGTGGCCATGGCGGCTGTGCCCATGGTGCTCAGTGCCATGGGCTTCACT
GCGGCGGGAATCGCCTCGTCCTCCATAGCAGCCAAGATGATGTCCGCGGCGGCCATTGCCAATGGGGGTGGAGTT
GCCTCGGGCAGCCTTGTGGGTACTCTGCAGTCACTGGGAGCAACTGGACTCTCCGGATTGACCAAGTTCATCCTG
GGCTCCATTGGGTCTGCCATTGCGGCTGTCATTGCGAGGTTCTACTAGCTCCCTGCCCCTCGCCCTGCAGAGAAG
AGAACCATGCCAGGGGAGAAGGCACCCAGCCATCCTGACCCAGCGAGGAGCCAACTATCCCAAATATACCTGGGT
GAAATATACCAAATTCTGCATCTCCAGAGGAAAATAAGAAATAAAGATGAATTGTTGCAACTCTTAAAAAAA

FIGURE 59

MEASALTSSAVTSVAKVVRVASGSAVVLPLARIATVVIGGVVAMAAVPMVLSAMGFTAAGIASSSIAAKMMSAAA
IANGGGVASGSLVGTLQSLGATGLSGLTKFILGSIGSAIAAVIARFY

FIGURE 60

```
CTCAGCTGCAGCGGCGACTTTCAGTTTCATTTCCACGGACCCTCCTGCCTGGGCCGCAGCCGCCGCCGCGATGCC
CAGTAAGTTCAGCTGCCGGCAGCTCCGGGAGGCGGGCCAGTGTTTCGAGAGTTTCCTGGTCGTTCGGGGACTGGA
CATGGAGACAGATCGCGAGCGGCTGCGGACCATTTATAACCGCGACTTCAAGATCAGCTTTGGGACCCCCGCCCC
TGGCTTCTCCTCCATGCTGTATGGAATGAAGATTGCAAATCTGGCCTACGTCACCAAGACTCGGGTCAGGTTCTT
CAGACTCGACCGCTGGGCCGACGTGCGGTTCCCAGAAAAGAGGAGAATGAAGCTGGGGTCAGATATCAGCAAACA
CCACAAGTCACTGCTAGCCAAGATCTTTTATGACAGGGCTGAGTATCTTCATGGGAAACATGGTGTGGATGTGGA
AGTCCAGGGGCCCCATGAAGCCCGAGATGGGCAGCTCCTTATCCGCCTGGATTTGAACCGCAAGAGGTGCTGAC
CCTGAGGCTTCGGAATGGCGGAACCCAGTCTGTTACCCTCACTCACCTCTTCCCACTCTGCCGGACACCCCAGTT
TGCTTTCTACAATGAAGACCAGGAGTTGCCCTGTCCACTGGGCCCGGTGAATGCTATGAACTCCATGTCCATTG
TAAGACCAGCTTTGTGGGCTACTTCCCAGCCACAGTGCTCTGGGAGCTGCTGGGACCTGGGGAGTCGGGTTCAGA
AGGAGCCGGCACATTCTACATTGCCCGCTTCTTGGCTGCCGTCGCCCACAGCCCCTGGCTGCACAGCTGAAGCC
CATGACTCCCTTCAAGCGGACCCGGATCACCGGAAACCCTGTGGTGACCAATCGGATAGAGGAAGGAGAGAGACC
TGACCGCGCTAAGGGCTATGACCTGGAGTTAAGTATGGCGCTGGGGACATACTACCCACCTCCCCGCCTCAGGCA
GCTGCTCCCCATGCTTCTTCAGGGAACAAGTATCTTCACTGCCCCTAAGGAGATCGCAGAGATCAAGGCCCAGCT
GGAGACAGCCCTGAAGTGGAGGAACTATGAGGTGAAGCTGCGGCTGCTGCTGCACCTGGAGGAACTGCAGATGGA
GCATGATATCCGGCACTATGACCTGGAGTCGGTGCCCATGACCTGGGACCCTGTGGACCAGAACCCCAGGCTGCT
CACGCTGGAGGTTCCTGGAGTGACTGAGAGCCGCCCCTCAGTGCTACGGGGCGACCACCTGTTTGCCCTTTTGTC
CTCGGAGACACACCAGGAGGACCCCATCACATATAAGGGCTTTGTGCACAAGGTGGAATTGGACCGTGTCAAGCT
GAGCTTTTCCATGAGCCTCCTGAGCCGCTTTGTGGATGGGCTGACCTTCAAGGTGAACTTTACCTTCAACCGCCA
GCCGCTGCGAGTCCAGCACCGTGCCCTGGAGCTGACAGGGCGCTGGCTGCTGTGGCCCATGCTCTTTCCTGTGGC
ACCTCGGGACGTCCCGCTGCTGCCCTCAGATGTGAAACTCAAGCTGTACGACCGGAGTCTGGAGTCAAACCCAGA
GCAGCTGCAGGCCATGAGGCACATTGTTACGGGCACCACCCGTCCAGCCCCCTACATCATCTTTGGGCCTCCAGG
CACCGGCAAGACTGTCACGTTAGTGGAGGCAATTAAGCAGGTGGTGAAGCACTTGCCCAAAGCCCACATCTTGGC
CTGCGCTCCATCCAACTCAGGGGCTGACCTACTCTGTCAAAGGCTCCGGGTCCACCTTCCTAGCTCCATCTACCG
CCTCCTGGCCCCAGCAGGGACATCCGCATGGTACCTGAGGACATCAAGCCCTGCTGCAACTGGGACGCAAAGAA
GGGGGAGTATGTATTTCCCGCCAAGAAGAAGCTGCAGGAATACCGGGTCTTAATTACCACCCTCATCACTGCCGG
CAGGTTGGTCTCGGCCCAGTTTCCCATTGATCACTTCACACACATCTTCATCGATGAGGCTGGCCACTGCATGGA
GCCTGAGAGTCTGGTAGCTATAGCAGGGCTGATGGAAGTAAAGGAAACAGGTGATCCAGGAGGGCAGCTGGTGCT
GGCAGGAGACCCTCGGCAGCTGGGGCCTGTGCTGCGTTCCCCACTGACCCAGAAGCATGGACTGGGATACTCACT
GCTGGAGCGGCTGCTCACCTACAACTCCCTGTACAAGAAGGGCCCTGATGGCTATGACCCCCAGTTCATAACCAA
GCTGCTCCGCAACTACAGGTCTCATCCCACCATCCTGGACATTCCTAACCAGCTCTATTATGAAGGGGAGCTGCA
GGCCTGTGCTGATGTCGTGGATCGAGAACGCTTCTGCCGCTGGGCGGGCCTACCTCGACAGGGCTTTCCCATCAT
CTTTCACGGCGTAATGGGCAAAGATGAGCGTGAAGGCAACAGCCCATCCTTCTTCAACCCTGAAGAGGCTGCCAC
AGTGACTTCCTACCTGAAGCTGCTCCTGGCCCCCTCCTCCAAGAAGGGCAAAGCTCGCCTGAGCCCTCGAAGTGT
GGGCGTCATCTCCCCGTACCGGAAACAGGTGGAGAAAATCCGTTACTGCATCACCAAACTTGACAGGGAGCTTCG
AGGACTGGATGACATCAAGGACTTGAAGGTGGGTTCAGTAGAAGAATTCCAAGGCCAAGAACGAAGCGTCATCCT
CATCTCCACCGTGCGAAGCAGCCAGAGCTTTGTGCAGCTGGATCTGGACTTTAATCTGGGTTTCCTTAAGAACCC
CAAGAGGTTCAATGTAGCTGTGACCCGGGCCAAGGCCCTGCTCATCATCGTGGGGAACCCCCTTCTCCTGGGCCA
TGACCCTGACTGGAAAGTATTCCTGGAGTTCTGTAAAGAAAACGGAGGGTATACCGGGTGTCCCTTCCCTGCCAA
ACTGGACCTGCAACAGGGACAGAATTTACTGCAAGGTCTGAGCAAGCTCAGCCCCTCTACCTCAGGGCCCCACAG
CCATGACTACCTCCCCCAGGAGCGGGAGGGTGAAGGGGGCCTGTCTCTGCAAGTGGAGCCAGAGTGGAGGAATGA
GCTCTGAAGACACAGCACCCAGCCTTCTCGCACCAGCCAAGCCTTAACTGCCTGCCTGACCCTGAACCAGAACCC
AGCTGAACTGCCCCTCCAAGGGACAGGAAGGCTGGGGGAGGGAGTTTACAACCCAAGCCATTCCACCCCCTCCCC
TGCTGGGGAGAATGACACATCAAGCTGCTAACAATTGGGGGAAGGGGAAGGAAGAAAACTCTGAAAACAAAATCT
TGTTCTATGCAAAAAAAAAAAAAAAAAAA
```

FIGURE 61

MPSKFSCRQLREAGQCFESFLVVRGLDMETDRERLRTIYNRDFKISFGTPAPGFSSMLYGMKIANLAYVTKTRVR
FFRLDRWADVRFPEKRRMKLGSDISKHHKSLLAKIFYDRAEYLHGKHGVDVEVQGPHEARDGQLLIRLDLNRKEV
LTLRLRNGGTQSVTLTHLFPLCRTPQFAFYNEDQELPCPLGPGECYELHVHCKTSFVGYFPATVLWELLGPGESG
SEGAGTFYIARFLAAVAHSPLAAQLKPMIPFKRIRITGNPVVTNRIEEGERPDRAKGYDLELSMALGTYYPPPRL
RQLLPMLLQGTSIFTAPKEIAEIKAQLETALKWRNYEVKLRLLLHLEELQMEHDIRHYDLESVPMTWDPVDQNPR
LLTLEVPGVTESRPSVLRGDHLFALLSSETHQEDPITYKGFVHKVELDRVKLSFSMSLLSRFVDGLTFKVNFTFN
RQPLRVQHRALELTGRWLLWPMLFPVAPRDVPLLPSDVKLKLYDRSLESNPEQLQAMRHIVTGTTRPAPYIIFGP
PGTGKTVTLVEAIKQVVKHLPKAHILACAPSNSGADLLCQRLRVHLPSSIYRLLAPSRDIRMVPEDIKPCCNWDA
KKGEYVFPAKKKLQEYRVLITTLITAGRLVSAQFPIDHFTHIFIDEAGHCMEPESLVAIAGLMEVKETGDPGGQL
VLAGDPRQLGPVLRSPLTQKHGLGYSLLERLLTYNSLYKKGPDGYDPQFITKLLRNYRSHPTIILDIPNQLYYEGE
LQACADVVDRERFCRWAGLPRQGFPIIFHGVMGKDEREGNSPSFFNPEEAATVTSYLKLLLAPSSKKGKARLSPR
SVGVISPYRKQVEKIRYCITKLDRELRGLDDIKDLKVGSVEEFQGQERSVILISTVRSSQSFVQLDLDFNLGFLK
NPKRFNVAVTRAKALLIIVGNPLLLGHDPDWKVFLEFCKENGGYTGCPFPAKLDLQQGQNLLQGLSKLSPSTSGP
HSHDYLPQEREGEGGLSLQVEPEWRNEL

FIGURE 62A

```
TGTGCTCTGTGGAGAGAGATACAATGATTTAGAGAAGCATATATGTTCAGTAAAACATGATGATGTTTATTTTGA
TCATTTTCATCCCTGTGCTGCGCTAACGACAGATATTATTGAAAAGTATGGATTCCCACCTGATCTTACCCTCAC
CCCTCAAGAAAGCATCCAGCTTTATGATACCATGGCTCAAGTCTGGGAAACTTGGCCCAGGGCTCAGGAATTGTG
TCCAGAGGAATTCATTCTTTTTAAGAATAAGATAGTCATTAAGAAGTTGGATGCTAGAAAATATGAAGAAACTT
AAAGGCAGAATTGACAAATTGGATTAAAAATGGCCAAGTGAAGAAGGTCAAAAGAGTACTGAAGAACCTTAGTCC
GGATTCATTGTCTAGTTCAAAAGATATGGTGAAAATGTTTCCTCTTCTTGTTGAAAAGTTAAGACAAATGGATAA
GTTGCCTGCAATATTTTTTTGTTAAGAATGATGATGTGGGAAAAAGAGCTGGAAGTGTGTGCACTTTTCTGGA
GAAGACAGAGACAAAAAGCCATCCCCACACTGAAAGTCATAGTTATGTCTTTGCAATAGATGAAGTACTTGAAAA
AGTGAGGAAGACACAGAAAAGGATCACTAAAAAAAAACCCAAAGAAGGCTGAAAAACTGGAAAGAAAAAAAGTGT
ATAGAGCTGAATATATTAATTTCCTGGAGAATCTGAAGATTCTGGAAATTTCTGAGGACTGCACGTATGCTGATG
TCAAAGCCCTACACACTGAAATTACCAGGAATAAAGACTCAACTTTGGATAGGGTATTACCGCGAGTGCGATTTA
CAAGACACGGCAAAGAACTGAAGGCTTTAGCACAAAGGGGGATTGGATATCATCACAGCAGCATGTATTTTAAAG
AAAAAGAGTTTGTTGAGATACTCTTTGTAAAAGGGCTTATTAGGGTAGTGACAGCTACTGAAACACTTGCCTTAG
GGATCCACATGCCATGCAAATCTATTGTTTTGCCCAAGACTCAGTCTATCTGGATGCTTTAAATTACAGACAGA
TGTCTGGTCGTGCTGGAAGAAGAGGTCAAGACCTGCTTGGAAATGTGTATTTCTTTGATATCCCATTGCCCAAAA
TAAAAAAGACTCCTTGCATCCAGTGTTCCTGAGCTGAGAGGACAGTTCCCTCTCAGCATAACCCTGGTCCTGCGA
CTCATGCTGCTGGCTTCCAAGGGAGATGACCCAGAGGATGCCAAGGCAAAGGTGTTGTCAGTGCTAAAGCATTCA
TTGCTGTCTTTTAAGAGACGAAGAGCCATGGAGACTTTGAAACTTTACTTTTTGTTTCCTTGCAGCTCCTTATC
AAAGAGGACTATTTAAATAAAAAGGGTAATCCAAAGAAATTTGCAGGACTTGCATCATATTTGCATGGTCATGAA
CCTTCAAATCTTGTTTTTGTAAATTTTCTCAAGAGAGGCCTTTTCCATAATCTCTGTAAGCCAGCCTGGAAAGGC
TCACAACAATTTTCCCAAGATGTGATGGAAAAGCTCGTGTTAGTATTGGCAAATTTGTTTGGAAGAAAATATATT
CCAGCAAAATTCCAAAATGCTGATTTAAGTTTTTCTCAGTCAAAGGTGATCCTTGCCGAACTCCCGGAGGATTTT
AAAGCTGCTTTATATGAGTATAACCTGGCAGTAATGAAGGATTTTGCCTCCTTCCTGCTGATTGCTTCCAAGTCG
GTGAACATGAAAAAAGAGCATCAACTCCCTTTGTCAAGAATCAAATTCACAGGTAAAGAATGTGAAGACTCCCAA
CTCGTGTCTCACTTGATGAGCTGCAAGAAAGGAAGAGTAGCCATTTCACCATTTGTTTGTCTTTCGGGGAACACA
GATAATGATTTGCTTCGACCAGAGACTATCAACCAGGTCATCCTGCGCACAGTCGGTGTTAGTGGCACTCAGGCT
CCTCTGCTGTGGCCATGGAAATTAGATAACCGAGGAAGGAGAATGCCACTAAATGCATATGTGCTCAATTTCTAT
AAACACAACTGCTTGACAAGATTAGACCAAAAAAATGGGATGCGTGTGGGACAGCTTTTAAAGTGTTTGAAAGAT
TTTGCATTCAACATTCAGGCTATCAGTGACTCCTTGAGTGAACTATGTGAAAATAAGCGTGACAATGTAGTCCTG
GCATTTAAACAATTGAGTCAAACCTTTTATGAGAAACTTCAAGAAATGCAAATTCAAATGAGTCAAAATCATTTA
GAATAACACCATGGAAAACTTTCAAGTCTGATTATGTGGTATTTATCTCTTTGCAAGGAGAGATATAATTAAGCT
TACACAATGAAATGGAAAAATGTTTGTCTTGGAGTCAAACAGAATTAAACTCAGATACCAGCTCTGCTATTTTC
TAACTGAATGACTTTAAGTTATGTAATATATCTGAGCTTTAACTTCATTTTTGGCAAAACCAGAGTAAAAATGAA
TACCTCTAGTTGTTTTGAGGATTAAATGAGATAATGTAAGAAAAGTGATTGGGATTGGGTGGTGACTTAATGAAC
GGTAGTGGTTTTTTAAGTAGTTAATGTATAGCAAAATTAGTTTCACATTGTCAAGTTTTCAATACATCCCCAAGT
TAATTGAATTTTAAATTAATGATCAATAAATCACAAAGGACCCAAATCAATTCTGAACAACAATTTAGTTATGTA
AGAAGACTTCTGAGATTACAAGAAACTCACTGCTGTGGACTGGATGTTTGTGCCCTCCCCTCCAAAATTTTATA
TTGAAATTCTAACCCTCAATGTGATGGTATTAGGAGATGATAGGTCATGAGGGTGGAGCTCCTTGGATGTAATTA
GTGCCTTTAACAGAGAGACAAGAGAGCTTGTTCTCCAATCTCTGCTCACTACCACTGGATGATACAATGGGAAGA
TGGCCATCTGCAGACCAAGAAGCAAGCCCTCAACAGAACTGAATCTACTTACACCATGATCTTGAACTTCCAGC
CTCCAGGATTGTGAGAAATACATGTTTGTTGTTTAGCCATCTAGTCTGTGGTTTTCTGTTGAAGCAGTCTGAATT
GACTAAAACAGTCACTTGGAGTAGTTATAAACCACTTTCCTGTTGAAAGCAGAACATGCTGATTCAACTGTTTTG
TTCAATAGCAATGATAGATTTTGTTTAAGTCCCCTACACTTTCTTATTTCTAAATGATCAAGAGTACACTTCCTG
GCAGTGATTAAGGAGTGTGTATCTAACAGAAAAAATATATATACCCTGTGAACCCGAATATGGAATTCAGATTGT
TTCTGCCCTCAGTATCATACTTAAAAAACAAGCATACAAACAAACATAAGGGAACAAACAGCAACCATAACAAAA
ACAAACCTTTAAAGGTGGGTTTTTGCTGTGATAAATGAATACGGTACTCTGAAGGAGAAAAAGTTTCTCAAATG
AGCTTAAACTGCAAGTGATTTAAAAATTAGAGAATATAATTCTTAAAGCTATTGAAAGTTTCAACCAGAAAACCT
CAAGTGAATTTTGTATGTAAATGAAATCTTGAATGTAAGTTCTGTGATTCTTTAAGCAAACAATTAGCTGAAAAC
```

FIGURE 62B

TTGGTATTGTTGTAGTTTATGTAGTAAGTGACTTGGCACCCATCAGAAAATAAAGGGCATTAAATTG

FIGURE 63

VLCGERYNDLEKHICSVKHDDVYFDHFHPCAALTTDIIEKYGFPPDLTLTPQESIQLYDTMAQVWETWPRAQELC
PEEFILFKNKIVIKKLDARKYEENLKAELTNWIKNGQVKKVKRVLKNLSPDSLSSSKDMVKMFPLLVEKLRQMDK
LPAIFFLFKNDDVGKRAGSVCTFLEKTETKSHPHTESHSYVFAIDEVLEKVRKTQKRITKKKPKEGEKLERKKVY
RAEYINFLENLKILEISEDCTYADVKALHTEITRNKDSTLDRVLPRVRFTRHGKELKALAQRGIGYHHSSMYFKE
KEFVEILFVKGLIRVVTATETLALGIHMPCKSIVFAQDSVYLDALNYRQMSGRAGRRGQDLLGNVYFFDIPLPKI
KKRLLASSVPELRGQFPLSITLVLRLMLLASKGDDPEDAKAKVLSVLKHSLLSFKRRRAMETLKLYFLFSLQLLI
KEDYLNKKGNPKKFAGLASYLHGHEPSNLVFVNFLKRGLFHNLCKPAWKGSQQFSQDVMEKLVLVLANLFGRKYI
PAKFQNADLSFSQSKVILAELPEDFKAALYEYNLAVMKDFASFLLIASKSVNMKKEHQLPLSRIKFTGKECEDSQ
LVSHLMSCKKGRVAISPFVCLSGNTDNDLLRPETINQVILRTVGVSGTQAPLLWPWKLDNRGRRMPLNAYVLNFY
KHNCLTRLDQKNGMRVGQLLKCLKDFAFNIQAISDSLSELCENKRDNVVLAFKQLSQTFYEKLQEMQIQMSQNHL
E

FIGURE 64

```
TAACTGAGCGAGGAGCAATTGATTAATAGCTCGGCGAGGGGACTCACTGACTGTTATAATAACACTACACCAGCA
ACTCCTGGCTTCCCAGCAGCCGGAACACAGACAGGAGAGAGTCAGTGGCAAATAGACATTTTTCTTATTTCTTAA
AAAACAGCAACTTGTTTGCTACTTTTATTTCTGTTGATTTTTTTTTCTTGGTGTGTGTGGTGGTTGTTTTTAAGT
GTGGAGGGCAAAAGGAGATACCATCCCAGGCTCAGTCCAACCCCTCTCCAAAACGGCTTTTCTGACACTCCAGGT
AGCGAGGGAGTTGGGTCTCCAGGTTGTGCGAGGAGCAAATGATGACCGCCAAGGCCGTAGACAAAATCCCAGTAA
CTCTCAGTGGTTTTGTGCACCAGCTGTCTGACAACATCTACCCGGTGGAGGACCTCGCCGCCACGTCGGTGACCA
TCTTTCCCAATGCCGAACTGGGAGGCCCCTTTGACCAGATGAACGGAGTGGCCGGAGATGGCATGATCAACATTG
ACATGACTGGAGAGAAGAGGTCGTTGGATCTCCCATATCCCAGCAGCTTTGCTCCCGTCTCTGCACCTAGAAACC
AGACCTTCACTTACATGGGCAAGTTCTCCATTGACCCTCAGTACCCTGGTGCCAGCTGCTACCCAGAAGGCATAA
TCAATATTGTGAGTGCAGGCATCTTGCAAGGGGTCACTTCCCCAGCTTCAACCACAGCCTCATCCAGCGTCACCT
CTGCCTCCCCCAACCCACTGGCCACAGGACCCCTGGGTGTGTGCACCATGTCCCAGACCCAGCCTGACCTGGACC
ACCTGTACTCTCCGCCACCGCCTCCTCCTCCTTATTCTGGCTGTGCAGGAGACCTCTACCAGGACCCTTCTGCGT
TCCTGTCAGCAGCCACCACCTCCACCTCTTCCTCTCTGGCCTACCCACCACCTCCTTCCTATCCATCCCCCAAGC
CAGCCACGGACCCAGGTCTCTTCCCAATGATCCCAGACTATCCTGGATTCTTTCCATCTCAGTGCCAGAGAGACC
TACATGGTACAGCTGGCCCAGACCGTAAGCCCTTTCCCTGCCCACTGGACACCCTGCGGGTGCCCCCTCCACTCA
CTCCACTCTCTACAATCCGTAACTTTACCCTGGGGGCCCCAGTGCTGGGGTGACCGGACCAGGGGCCAGTGGAG
GCAGCGAGGGACCCCGGCTGCCTGGTAGCAGCTCAGCAGCAGCAGCAGCCGCCGCCGCCGCCGCCTATAACCCAC
ACCACCTGCCACTGCGGCCCATTCTGAGGCCTCGCAAGTACCCCAACAGACCCAGCAAGACGCCGGTGCACGAGA
GGCCCTACCCGTGCCCAGCAGAAGGCTGCGACCGGCGGTTCTCCCGCTCTGACGAGCTGACACGGCACATCCGAA
TCCACACTGGGCATAAGCCCTTCCAGTGTCGGATCTGCATGCGCAACTTCAGCCGCAGTGACCACCTCACCACCC
ATATCCGCACCCACACCGGTGAGAAGCCCTTCGCCTGTGACTACTGTGGCCGAAAGTTTGCCCGGAGTGATGAGA
GGAAGCGCCACACCAAGATCCACCTGAGACAGAAAGAGCGGAAAAGCAGTGCCCCCTCTGCATCGGTGCCAGCCC
CCTCTACAGCCTCCTGCTCTGGGGGCGTGCAGCCTGGGGTACCCTGTGCAGCAGTAACAGCAGCAGTCTTGGCG
GAGGGCCGCTCGCCCCTTGCTCCTCTCGGACCCGGACACCTTGAGATGAGACTCAGGCTGATACACCAGCTCCCA
AAGGTCCCGGAGGCCCTTTGTCCACTGGAGCTGCACAACAAACACTACCACCCTTTCCTGTCCCTCTCTCCCTTT
GTTGGGCAAAGGGCTTTGGTGGAGCTAGCACTGCCCCCTTTCCACCTAGAAGCAGGTTCTTCCTAAAACTTAGCC
CATTCTAGTCTCTCTTAGGTGAGTTGACTATCAACCCAAGGCAAAGGGGAGGCTCAGAAGGAGGTGGTGTGGGGA
TCCCCTGGCCAAGAGGGCTGAGGTCTGACCCTGCTTTAAAGGGTTGTTTGACTAGGTTTTGCTACCCCACTTCCC
CTTATTTTGACCCATCACAGGTTTTTGACCCTGGATGTCAGAGTTGATCTAAGACGTTTTCTACAATAGGTTGGG
AGATGCTGATCCCTTCAAGTGGGGACAGCAAAAAGACAAGCAAAACTGATGTGCACTTTATGGCTTGGGACTGAT
TTGGGGGACATTGTACAGTGAGTGAAGTATAGCCTTTATGCCACACTCTGTGGCCCTAAAATGGTGAATCAGAGC
ATATCTAGTTGTCTCAACCCTTGAAGCAATATGTATTATATACTCAGAGAACAGAAGTGCAATGTGATGGGAGGA
ACGTAGCAATATCTGCTCCTTTTCGAGTTGTTTGAGAAATGTAGGCTATTTTTCAGTGTATATCCACTCAGATT
TTGTGTATTTTTGATGTACCCACACTGTTCTCTAAATTCTGAATCTTTGGGAAAAAATGTAAAGCATTTATGATC
TCAGAGGTTAACTTATTTAAGGGGGATGTACATATTCTCTGAAACTAGGATGCATGCAATTGTGTTGGAAGTGTC
CTTGGTCGCCTTGTGTGATGTAGACAAATGTTACAAGGCTGCATGTAAATGGGTTGCCTTATTATGGAGAAAAAA
ATCACTCCCTGAGTTTAGTATGGCTGTATATTTATGCCTATTAATATTTGGAATTTTTTTTAGAAAGTATATTTT
TGTATGCTTGTTTTGTGACTTAAAAGTGTTACCTTTGTAGTCAAATTTCAGATAAGAATGTACATAATGTTACC
GGAGCTGATTTGTTTGGTCATTAGCTCTTAATAGTTGTGAAAAAATAAATCTATTCTAACGCAAAACCACTAACT
GAAGTTCAGATATAATGGATGGTTTGTGACTATAGTGTAAATAAATACTTTTCAACAAT
```

FIGURE 65

MMTAKAVDKIPVTLSGFVHQLSDNIYPVEDLAATSVTIFPNAELGGPFDQMNGVAGDGMINIDMTGEKRSLDLPY
PSSFAPVSAPRNQTFTYMGKFSIDPQYPGASCYPEGIINIVSAGILQGVTSPASTTASSSVTSASPNPLATGPLG
VCTMSQTQPDLDHLYSPPPPPPPYSGCAGDLYQDPSAFLSAATTSTSSSLAYPPPPSYPSPKPATDPGLFPMIPD
YPGFFPSQCQRDLHGTAGPDRKPFPCPLDTLRVPPPLTPLSTIRNFTLGGPSAGVTGPGASGGSEGPRLPGSSSA
AAAAAAAAAYNPHHLPLRPILRPRKYPNRPSKTPVHERPYPCPAEGCDRRFSRSDELTRHIRIHTGHKPFQCRIC
MRNFSRSDHLTTHIRTHTGEKPFACDYCGRKFARSDERKRHTKIHLRQKERKSSAPSASVPAPSTASCSGGVQPG
GTLCSSNSSSLGGGPLAPCSSRTRTP

FIGURE 66

```
TAGTTATTAAAGTTCCTATGCAGCTCCGCCTCCGTCCGGCCTCATTTCCTCAAAAAATCCCTGCTTTCCCCGCTC
GCCACGCCCTCCTGCTACCCGGCTTTAAAGCTAGTGAGGCACAGCCTGCGGGGAACGTAGCTAGCTGCAAGCAGA
GGCCGGCATGACCACCGAGCAGCGACGCAGCCTGCAAGCCTTCCAGGATTATATCCGGAAGACCCTGGACCCTAC
CTACATCCTGAGCTACATGGCCCCCTGGTTTAGGGAGGAAGAGGTGCAGTATATTCAGGCTGAGAAAAACAACAA
GGGCCCAATGGAGGCTGCCACACTTTTTCTCAAGTTCCTGTTGGAGCTCCAGGAGGAAGGCTGGTTCCGTGGCTT
TTTGGATGCCCTAGACCATGCAGGTTATTCTGGACTTTATGAAGCCATTGAAAGTTGGGATTTCAAAAAAATTGA
AAAGTTGGAGGAGTATAGATTACTTTTAAAACGTTTACAACCAGAATTTAAAACCAGAATTATCCCAACCGATAT
CATTTCTGATCTGTCTGAATGTTTAATTAATCAGGAATGTGAAGAAATTCTACAGATTTGCTCTACTAAGGGGAT
GATGGCAGGTGCAGAGAAATTGGTGGAATGCCTTCTCAGATCAGACAAGGAAAACTGGCCCAAAACTTTGAAACT
TGCTTTGGAGAAAGAAAGGAACAAGTTCAGTGAACTGTGGATTGTAGAGAAAGGTATAAAAGATGTTGAAACAGA
AGATCTTGAGGATAAGATGGAAACTTCTGACATACAGATTTTCTACCAAGAAGATCCAGAATGCCAGAATCTTAG
TGAGAATTCATGTCCACCTTCAGAAGTGTCTGATACAAACTTGTACAGCCCATTTAAACCAAGAAATTACCAATT
AGAGCTTGCTTTGCCTGCTATGAAAGGAAAAAACACAATAATATGTGCTCCTACAGGTTGTGGAAAAACCTTTGT
TTCACTGCTTATATGTGAACATCATCTTAAAAAATTCCCACAAGGACAAAAGGGGAAAGTTGTCTTTTTTGCGAA
TCAGATCCCAGTGTATGAACAGCAGAAATCTGTATTCTCAAAATACTTTGAAAGACATGGGTATAGAGTTACAGG
CATTTCTGGAGCAACAGCTGAGAATGTCCCAGTGGAACAGATTGTTGAGAACAATGACATCATCATTTTAACTCC
ACAGATTCTTGTGAACAACCTTAAAAAGGGAACGATTCCATCACTATCCATCTTTACTTTGATGATATTTGATGA
ATGCCACAACACTAGTAAACAACACCCGTACAATATGATCATGTTTAATTATCTAGATCAGAAACTTGGAGGATC
TTCAGGCCCACTGCCCCAGGTCATTGGGCTGACTGCCTCGGTTGGTGTTGGGGATGCCAAAAACACAGATGAAGC
CTTGGATTATATCTGCAAGCTGTGTGCTTCTCTTGATGCGTCAGTGATAGCAACAGTCAAACACAATCTGGAGGA
ACTGGAGCAAGTTGTTTATAAGCCCCAGAAGTTTTTCAGGAAAGTGGAATCACGGATTAGCGACAAATTTAAATA
CATCATAGCTCAGCTGATGAGGGACACAGAGAGTCTGGCAAAGAGAATCTGCAAAGACCTCGAAAACTTATCTCA
AATTCAAAATAGGGAATTTGGAACACAGAAATATGAACAATGGATTGTTACAGTTCAGAAAGCATGCATGGTGTT
CCAGATGCCAGACAAAGATGAAGAGAGCAGGATTTGTAAAGCCCTGTTTTTATACACTTCACATTTGCGGAAATA
TAATGATGCCCTCATTATCAGTGAGCATGCACGAATGAAAGATGCTCTGGATTACTTGAAAGACTTCTTCAGCAA
TGTCCGAGCAGCAGGATTCGAAGAGATTGAGCAAGATCTTACTCAGAGATTTGAAGAAAAGCTGCAGGAACTAGA
AAGTGTTTCCAGGGATCCCAGCAATGAGAATCCTAAACTTGAAGACCTCTGCTTCATCTTACAAGAAGAGTACCA
CTTAAACCCAGAGACAATAACAATTCTCTTTGTGAAAACCAGAGCACTTGTGGACGCTTTAAAAAATTGGATTGA
AGGAAATCCTAAACTCAGTTTTCTAAAACCTGGCATATTGACTGGACGTGGCAAAACAAATCAGAACACAGGAAT
GACCCTCCCGGCACAGAAGTGTATATTGGATGCATTCAAAGCCAGTGGAGATCACAATATTCTGATTGCCACCTC
AGTTGCTGATGAAGGCATTGACATTGCACAGTGCAATCTTGTCATCCTTTATGAGTATGTGGGCAATGTCATCAA
AATGATCCAAACCAGAGGCAGAGGAAGAGCAAGAGGTAGCAAGTGCTTCCTTCTGACTAGTAATGCTGGTGTAAT
TGAAAAGAACAAATAAACATGTACAAAGAAAAAATGATGAATGACTCTATTTTACGCCTTCAGACATGGGACGA
AGCAGTATTTAGGGAAAAGATTCTGCATATACAGACTCATGAAAAATTCATCAGAGATAGTCAAGAAAAACCAAA
ACCTGTCCCTGATAAGGAAAATAAAAAACTGCTCTGCAGAAAGTGCAAAGCCTTGGCATGTTACACAGCTGACGT
AAGAGTGATAGAGGAATGCCATTACACTGTGCTTGGAGATGCTTTTAAGGAATGCTTTGTGAGTAGACCACATCC
CAAGCCAAAGCAGTTTTCAAGTTTTGAAAAAAGAGCAAAGATATTCTGTGCCCGACAGAACTGCAGCCATGACTG
GGGAATCCATGTGAAGTACAAGACATTTGAGATTCCAGTTATAAAAATTGAAAGTTTTGTGGTGGAGGATATTGC
AACTGGAGTTCAGACACTGTACTCGAAGTGGAAGGACTTTCATTTTGAAGAATACCATTTGATCCAGCAGAAAT
GTCCAAATGATATCAGGTCCTCAATCTTCAGCTACAGGGAATGAGTAACTTTGAGTGGAGAAGAAACAAACATAG
TGGGTATAATCATGGATCGCTTGTACCCCTGTGAAAATATATTTTTTAAAAATAAAAAAAAAAAA
```

FIGURE 67

MTTEQRRSLQAFQDYIRKTLDPTYILSYMAPWFREEEVQYIQAEKNNKGPMEAATLFLKFLLELQEEGWFRGFLD
ALDHAGYSGLYEAIESWDFKKIEKLEEYRLLLKRLQPEFKTRIIPTDIISDLSECLINQECEEILQICSTKGMMA
GAEKLVECLLRSDKENWPKTLKLALEKERNKFSELWIVEKGIKDVETEDLEDKMETSDIQIFYQEDPECQNLSEN
SCPPSEVSDTNLYSPFKPRNYQLELALPAMKGKNTIICAPTGCGKTFVSLLICEHHLKKFPQGQKGKVVFFANQI
PVYEQQKSVFSKYFERHGYRVTGISGATAENVPVEQIVENNDIIILTPQILVNNLKKGTIPSLSIFTLMIFDECH
NTSKQHPYNMIMFNYLDQKLGGSSGPLPQVIGLTASVGVGDAKNTDEALDYICKLCASLDASVIATVKHNLEELE
QVVYKPQKFFRKVESRISDKFKYIIAQLMRDTESLAKRICKDLENLSQIQNREFGTQKYEQWIVTVQKACMVFQM
PDKDEESRICKALFLYTSHLRKYNDALIISEHARMKDALDYLKDFFSNVRAAGFEEIEQDLTQRFEEKLQELESV
SRDPSNENPKLEDLCFILQEEYHLNPETITILFVKTRALVDALKNWIEGNPKLSFLKPGILTGRGKTNQNTGMTL
PAQKCILDAFKASGDHNILIATSVADEGIDIAQCNLVILYEYVGNVIKMIQTRGRGRARGSKCFLLTSNAGVIEK
EQINMYKEKMMNDSILRLQTWDEAVFREKILHIQTHEKFIRDSQEKPKPVPDKENKKLLCRKCKALACYTADVRV
IEECHYTVLGDAFKECFVSRPHPKPKQFSSFEKRAKIFCARQNCSHDWGIHVKYKTFEIPVIKIESFVVEDIATG
VQTLYSKWKDFHFEKIPFDPAEMSK

FIGURE 68

CCGAGCGCCAGCGCGGGGAACCGGGAAAAGGAAACCGTGTTGTGTACGTAAGATTCAGGAAACGAAACCAGGAGC
CGCGGGTGTTGGCGCAAAGGTTACTCCCAGACCCTTTTCCGGCTGACTTCTGAGAAGGTTGCGCACAGCTGTGCC
CGGCAGTCTAGAGGCGCAGAAGAGGAAGCCATCGCCTGGCCCCGGCTCTCTGGACCTTGTCTCGCTCGGGAGCGG
AAACAGCGGCAGCCAGAGAACTGTTTTAATCATGGACAAACAAAACTCACAGATGAATGCTTCTCACCCGGAAAC
AAACTTGCCAGTTGGGTATCCTCCTCAGTATCCACCGACAGCATTCCAAGGACCTCCAGGATATAGTGGCTACCC
TGGGCCCCAGGTCAGCTACCCACCCCCACCAGCCGGCCATTCAGGTCCTGGCCCAGCTGGCTTTCCTGTCCCAAA
TCAGCCAGTGTATAATCAGCCAGTATATAATCAGCCAGTTGGAGCTGCAGGGGTACCATGGATGCCAGCGCCACA
GCCTCCATTAAACTGTCCACCTGGATTAGAATATTTAAGTCAGATAGATCAGATACTGATTCATCAGCAAATTGA
ACTTCTGGAAGTTTTAACAGGTTTTGAAACTAATAACAAATATGAAATTAAGAACAGCTTTGGACAGAGGGTTTA
CTTTGCAGCGGAAGATACTGATTGCTGTACCCGAAATTGCTGTGGGCCATCTAGACCTTTTACCTTGAGGATTAT
TGATAATATGGGTCAAGAAGTCATAACTCTGGAGAGACCACTAAGATGTAGCAGCTGTTGTTGTCCCTGCTGCCT
TCAGGAGATAGAAATCCAAGCTCCTCCTGGTGTACCAATAGGTTATGTTATTCAGACTTGGCACCCATGTCTACC
AAAGTTTACAATTCAAAATGAGAAAAGAGAGGATGTACTAAAAATAAGTGGTCCATGTGTTGTGTGCAGCTGTTG
TGGAGATGTTGATTTGAGATTAAATCTCTTGATGAACAGTGTGTGGTTGGCAAAATTTCCAAGCACTGGACTGG
AATTTTGAGAGAGGCATTTACAGACGCTGATAACTTTGGAATCCAGTTCCCTTTAGACCTTGATGTTAAAATGAA
AGCTGTAATGATTGGTGCCTGTTTCCTCATTGACTTCATGTTTTTTGAAAGCACTGGCAGCCAGGAACAAAAATC
AGGAGTGTGGTAGTGGATTAGTGAAAGTCTCCTCAGGAAATCTGAAGTCTGTATATTGATTGAGACTATCTAAAC
TCATACCTGTATGAATTAAGCTGTAAGGCCTGTAGCTCTGGTTGTATACTTTTGCTTTCAAATTATAGTTTATC
TTCTGTATAACTGATTTATAAAGGTTTTTGTACATTTTTAATACTCATTGTCAATTTGAGAAAAAGGACATATG
AGTTTTTGCATTTATTAATGAAACTTCCTTTGAAAAACTGCTTTGAATTATGATCTCTGATTCATTGTCCATTTT
ACTACCAAATATTAACTAAGGCCTTATTAATTTTTATATAAATTATATCTTGTCCTATTAAATCTAGTTACAATT
TATTTCATGCATAAGAGCTAATGTTATTTTGCAAATGCCATATATTCAAAAAAGCTCAAAGATAATTTTCTTTAC
TATTATGTTCAAATAATATTCAATATGCATATTATCTTTAAAAAGTTAAATGTTTTTTTAATCTTCAAGAAATCA
TGCTACACTTAACTTCTCCTAGAAGCTAATCTATACCATAATATTTTCATATTCACAAGATATTAAATTACCAAT
TTCAAATTATTGTTAGTAAAGAACAAAATGATTCTCTCCCAAAGAAAGACACATTTTAAATACTCCTTCACTCT
AAAACTCTGGTATTATAACTTTTGAAAGTTAATATTTCTACATGAAATGTTTAGCTCTTACACTCTATCCTTCCT
AGAAAATGGTAATTGAGATTACTCAGATATTAATTAAATACAATATCATATATATATTCACAGAGTATAAACCTA
AATAATGATCTATTAGATTCAAATATTTGAAATAAAAACTTGATTTTTTGT

FIGURE 69

MDKQNSQMNASHPETNLPVGYPPQYPPTAFQGPPGYSGYPGPQVSYPPPPAGHSGPGPAGFPVPNQPVYNQPVYN
QPVGAAGVPWMPAPQPPLNCPPGLEYLSQIDQILIHQQIELLEVLTGFETNNKYEIKNSFGQRVYFAAEDTDCCT
RNCCGPSRPFTLRIIDNMGQEVITLERPLRCSSCCCPCCLQEIEIQAPPGVPIGYVIQTWHPCLPKFTIQNEKRE
DVLKISGPCVVCSCCGDVDFEIKSLDEQCVVGKISKHWTGILREAFTDADNFGIQFPLDLDVKMKAVMIGACFLI
DFMFFESTGSQEQKSGVW

FIGURE 70

```
GAATTCGCACTGCTCTGAGAATTTGTGAGCAGCCCCTAACAGGCTGTTACTTCACTACAACTGACGATATGATCA
TCTTAATTTACTTATTTCTCTTGCTATGGGAAGACACTCAAGGATGGGGATTCAAGGATGGAATTTTTCATAACT
CCATATGGCTTGAACGAGCAGCCGGTGTGTACCACAGAGAAGCACGGTCTGGCAAATACAAGCTCACCTACGCAG
AAGCTAAGGCGGTGTGTGAATTTGAAGGCGGCCATCTCGCAACTTACAAGCAGCTAGAGGCAGCCAGAAAAATTG
GATTTCATGTCTGTGCTGCTGGATGGATGGCTAAGGGCAGAGTTGGATACCCCATTGTGAAGCCAGGGCCCAACT
GATGATTTGGAAAAACTGGCATTATTGATTATGGAATCCGTCTCAATAGGAGTGAAAGATGGGATGCCTATTGCT
ACAACCCACACGCAAAGGAGTGTGGTGGCGTCTTTACAGATCCAAAGCGAATTTTTAAATCTCCAGGCTTCCCAA
ATGAGTACGAAGATAACCAAATCTGCTACTGGCACATTAGACTCAAGTATGGTCAGCGTATTCACCTGAGTTTTT
TAGATTTTGACCTTGAAGATGACCCAGGTTGCTTGGCTGATTATGTTGAAATATATGACAGTTACGATGATGTCC
ATGGCTTTGTGGGAAGATACTGTGGAGATGAGCTTCCAGATGACATCATCAGTACAGGAAATGTCATGACCTTGA
AGTTTCTAAGTGATGCTTCAGTGACAGCTGGAGGTTTCCAAATCAAATATGTTGCAATGGATCCTGTATCCAAAT
CCAGTCAAGGAAAAAATACAAGTACTACTTCTACTGGAAATAAAAACTTTTTAGCTGGAAGATTTAGCCACTTAT
AAAAAAAAAAAAGGATGATCAAAACACACAGTGTTTATGTTGGAATCTTTTGGAACTCCTTTGATCTCACTGTTA
TTATTAACATTTATTTATTATTTTTCTAAATGTGAAAGAAATACATAATTTAGGGAAAATTGGAAAATATAGGAA
ACTTTAAACGAGAAAATGAAACCTCTCATAATCCCACTGCATAGAAATAACAAGCGTTAACATTTTCATATTTTT
TTCTTTCAGTCATTTTTGTATTTGTGGTATATGTATATATGTACCTATATGTATTTGCATTTGAAATTTTGGAAT
CCTGCTCTATGTACAGTTTTGTATTATACTTTTTAAATCTTGAACTTTATGAACATTTTCTGAAATCATTGATTA
TTCTACAAAAACATGATTTTAAACAGCTGTAAAATATTCTATGATATGAATGTTTTATGCATTATTTAAGCCTGT
CTCTATTGTTGGAATTTCAGGTCATTTTCATAAATATTGTTGCAATAAATATCCTTCGGAATTC
```

FIGURE 71

```
CCGCAGAACTTGGGGAGCCGCCGCCGCCATCCGCCGCCGCAGCCAGCTTCCGCCGCCGCAGGACCGGCCCCTGCC
CCAGCCTCCGCAGCCGCGGCGCGTCCACGCCCGCCCGCGCCCAGGGCGAGTCGGGGTCGCCGCCTGCACGCTTCT
CAGTGTTCCCCGCGCCCCGCATGTAACCCGGCCAGGCCCCGCAACGGTGTCCCCTGCAGCTCCAGCCCCGGGCT
GCACCCCCCGCCCCGACACCAGCTCTCCAGCCTGCTCGTCCAGGATGGCCGCGGCCAAGGCCGAGATGCAGCTG
ATGTCCCCGCTGCAGATCTCTGACCCGTTCGGATCCTTTCCTCACTCGCCCACCATGGACAACTACCCTAAGCTG
GAGGAGATGATGCTGCTGAGCAACGGGGCTCCCCAGTTCCTCGGCGCCGCCGGGGCCCCAGAGGGCAGCGGCAGC
AACAGCAGCAGCAGCAGCAGCGGGGCGGTGGAGGCGGCGGGGGCGGCAGCAACAGCAGCAGCAGCAGCACC
TTCAACCCTCAGGCGGACACGGGCGAGCAGCCCTACGAGCACCTGACCGCAGAGTCTTTTCCTGACATCTCTCTG
AACAACGAGAAGGTGCTGGTGGAGACCAGTTACCCCAGCCAAACCACTCGACTGCCCCCCATCACCTATACTGGC
CGCTTTTCCCTGGAGCCTGCACCCAACAGTGGCAACACCTTGTGGCCCGAGCCCCTCTTCAGCTTGGTCAGTGGC
CTAGTGAGCATGACCAACCCACCGGCCTCCTCGTCCTCAGCACCATCTCCAGCGGCCTCCTCCGCCTCCGCCTCC
CAGAGCCCACCCCTGAGCTGCGCAGTGCCATCCAACGACAGCAGTCCCATTTACTCAGCGGCACCCACCTTCCCC
ACGCCGAACACTGACATTTTCCCTGAGCCACAAAGCCAGGCCTTCCCGGGCTCGGCAGGGACAGCGCTCCAGTAC
CCGCCTCCTGCCTACCCTGCCGCCAAGGGTGGCTTCCAGGTTCCCATGATCCCCGACTACCTGTTTCCACAGCAG
CAGGGGGATCTGGGCCTGGGCACCCCAGACCAGAAGCCCTTCCAGGGCCTGGAGAGCCGCACCCAGCAGCCTTCG
CTAACCCCTCTGTCTACTATTAAGGCCTTTGCCACTCAGTCGGGCTCCCAGGACCTGAAGGCCCTCAATACCAGC
TACCAGTCCCAGCTCATCAAACCCAGCCGCATGCGCAAGTATCCCAACCGGCCCAGCAAGACGCCCCCCCACGAA
CGCCCTTACGCTTGCCCAGTGGAGTCCTGTGATCGCCGCTTCTCCCGCTCCGACGAGCTCACCCGCCACATCCGC
ATCCACACAGGCCAGAAGCCCTTCCAGTGCCGCATCTGCATGCGCAACTTCAGCCGCAGCGACCACCTCACCACC
CACATCCGCACCCACACAGGCGAAAAGCCCTTCGCCTGCGACATCTGTGGAAGAAAGTTTGCCAGGAGCGATGAA
CGCAAGAGGCATACCAAGATCCACTTGCGGCAGAAGGACAAGAAAGCAGACAAAAGTGTTGTGGCCTCTTCGGCC
ACCTCCTCTCTCTTCCTACCCGTCCCCGGTTGCTACCTCTTACCCGTCCCCGGTTACTACCTCTTATCCATCC
CCGGCCACCACCTCATACCCATCCCCTGTGCCCACCTCCTTCTCCTCTCCCGGCTCCTCGACCTACCCATCCCT
GTGCACAGTGGCTTCCCCTCCCCGTCGGTGGCCACCACGTACTCCTCTGTTCCCCCTGCTTTCCCGGCCCAGGTC
AGCAGCTTCCCTTCCTCAGCTGTCACCAACTCCTTCAGCGCCTCCACAGGGCTTTCGGACATGACAGCAACCTTT
TCTCCCAGGACAATTGAAATTTGCTAAAGGGAAAGGGGAAAGAAAGGGAAAAGGGAGAAAAAGAAACACAAGAGA
CTTAAAGGACAGGAGGAGGAGATGGCCATAGGAGAGGAGGGTTCCTCTTAGGTCAGATGGAGGTTCTCAGAGCCA
AGTCCTCCCTCTCTACTGGAGTGGAAGGTCTATTGGCCAACAATCCTTTCTGCCCACTTCCCCTTCCCCAATTAC
TATTCCCTTTGACTTCAGCTGCCTGAAACAGCCATGTCCAAGTTCTTCACCTCTATCCAAGAACTTGATTTGCA
TGGATTTTGGATAAATCATTTCAGTATCATCTCCATCATATGCCTGACCCCTTGCTCCCTTCAATGCTAGAAAAT
CGAGTTGGCAAAATGGGGTTTGGGCCCCTCAGAGCCCTGCCCTGCACCCTTGTACAGTGTCTGTGCCATGGATTT
CGTTTTTCTTGGGGTACTCTTGATGTGAAGATAATTTGCATATTCTATTGTATTATTTGGAGTTAGGTCCTCACT
TGGGGGAAAAAAAAAAAAAAAAGCCAAGCAAACCAATGGTGATCCTCTATTTTGTGATGATGCTGTGACAATAAG
TTTGAACCTTTTTTTTGAAACAGCAGTCCCAGTATTCTCAGAGCATGTGTCAGAGTGTTGTTCCGTTAACCTTT
TTGTAAATACTGCTTGACCGTACTCTCACATGTGGCAAAATATGGTTTGGTTTTCTTTTTTTTTTTGAAAGTG
TTTTTTCTTCGTCCTTTTGGTTTAAAAAGTTTCACGTCTTGGTGCCTTTTGTGTGATGCCCCTTGCTGATGGCTT
GACATGTGCAATTGTGAGGGACATGCTCACCTCTAGCCTTAAGGGGGCAGGGAGTGATGATTTGGGGGAGGCTT
TGGGAGCAAAATAAGGAAGAGGGCTGAGCTGAGCTTCGGTTCTCCAGAATGTAAGAAAACAAAATCTAAAACAAA
ATCTGAACTCTCAAAAGTCTATTTTTTAACTGAAAATGTAAATTTATAAATATATTCAGGAGTTGGAATGTTGT
AGTTACCTACTGAGTAGGCGGCGATTTTTGTATGTTATGAACATGCAGTTCATTATTTTGTGGTTCTATTTTACT
TTGTACTTGTGTTTGCTTAAACAAAGTGACTGTTTGGCTTATAAACACATTGAATGCGCTTTATTGCCCATGGGA
TATGTGGTGTATATCCTTCCAAAAAATTAAAACGAAAATAAAGTAGCTGCGATTGGG
```

FIGURE 72

MAAAKAEMQLMSPLQISDPFGSFPHSPTMDNYPKLEEMMLLSNGAPQFLGAAGAPEGSGSNSSSSSSGGGGGGGG
GSNSSSSSSTFNPQADTGEQPYEHLTAESFPDISLNNEKVLVETSYPSQTTRLPPITYTGRFSLEPAPNSGNTLW
PEPLFSLVSGLVSMTNPPASSSSAPSPAASSASASQSPPLSCAVPSNDSSPIYSAAPTFPTPNTDIFPEPQSQAF
PGSAGTALQYPPPAYPAAKGGFQVPMIPDYLFPQQQGDLGLGTPDQKPFQGLESRTQQPSLTPLSTIKAFATQSG
SQDLKALNTSYQSQLIKPSRMRKYPNRPSKTPPHERPYACPVESCDRRFSRSDELTRHIRIHTGQKPFQCRICMR
NFSRSDHLTTHIRTHTGEKPFACDICGRKFARSDERKRHTKIHLRQKDKKADKSVVASSATSSLSSYPSPVATSY
PSPVTTSYPSPATTSYPSPVPTSFSSPGSSTYPSPVHSGFPSPSVATTYSSVPPAFPAQVSSFPSSAVTNSFSAS
TGLSDMTATFSPRTIEIC

FIGURE 73

```
AATCTGTGGTTTTTGCTCAAAACTCAGTCTATCTGGATGCGTTGAATTATAGACAGATGTCTGGCCGTGCTGGAA
GAAGAGGTCAAGACCTGATGGGAGATGTATATTTCTTTGATATTCCATTCCCCAAAATAGGAAAACTCATAAAAT
CCAATGTTCCTGAGCTGAGAGGACACTTCCCTCTCAGCATAACCCTGGTCCTGCGACTCATGCTGCTGGCTTCCA
AGGGAGATGACCCAGAGGATGCCAAGGCAAAGGTGCTATCAGTGCTAAAGCATTCATTGCTGTCCTTCAAGCAAC
CCAGAGTCATGGACATGTTAAAACTTTACTTCCTGTTTTCTTTGCAGTTCCTGGTGAAAGAGGGCTATTTAGATC
AAGAAGGTAATCCTATGGGGTTTGCTGGACTTGTGTCACATTTGCATTATCATGAACCTTCTAATCTTGTTTTTG
TGAGTTTTCTTGTAAATGGCCTCTTCCATGATCTCTGTCAGCCAACCAGGAAAGGCTCAAAACATTTTTCTCAAG
ACGTTATGGAAAAGCTAGTATTAGTATTGGCACATCTCTTTGGAAGAAGATATTTTCCACCAAAGTTCCAGGATG
CACACTTCGAGTTTTATCAATCAAAGGTGTTCCTTGATGATCTCCCTGAGGATTTTAGTGATGCTTTAGATGAAT
ATAACATGAAAATTATGGAGGACTTTACCACTTTCCTACGAATTGTTTCCAAACTGGCTGATATGAATCAGGAAT
ATCAACTCCCATTGTCAAAAATCAAATTCACAGGTAAAGAATGTGAAGACTCTCAACTCGTATCTCATTTGATGA
GCTGCAAGGAAGGAAGAGTAGCAATTTCACCATTTGTTTGTCTGTCTGGGAACTTTGATGATGATTTGCTTCGAC
TAGAAACTCCAAACCATGTTACTCTAGGCACAATCGGTGTCAATCGCTCTCAGGCTCCAGTGCTGTTGTCACAGA
AATTTGATAACCGAGGAAGGAAAATGTCGCTTAATGCCTATGCACTGGATTTCTACAAACATGGTTCCTTGATAG
GATTAGTCCAGGATAACAGGATGAATGAAGGAGATGCTTATTATTTGTTGAAGGATTTTGCACTCACCATTAAAT
CTATCAGTGTTTCCTTGCGTGAGCTATGTGAAAATGAAGACGACAACGTTGTCTTAGCCTTTGAACAACTGAGTA
CAACTTTTTGGGAAAAGTTAAACAAAGTCTAAAAACAAAGTCTATGCAAACCACTCAAAAATAATTCCATAGTAG
TTTTTCAGGTCACGTTTTTGATTCTTATGCTTCTTGCCAGAAATACATTATGATAAAGTGGAAATACATTACGAT
GAAGTGGAAAGAGCAAACACTTTGGAATCAAACAGAGTTGCAATCAAACCTGCCATGTTCTGTCATGAATACTCA
CAAATTATTTAGTATACCTGAATCTTGGTTTCTTTTTATAACTGAGTAATAATGGTTACATCTCAGGTAGTTTGA
GGATTGACTAAAAAAATGCGAGAATGTTGTATGTGACTGAATAACAATTTTTACTCTGCGAAGCCAAAGTAAATA
TAATATTATCAGTAACTTTATCCCCAGTGTCAGTATTTATAAAATGTTTATTAAGGCTAGAAAAAATGAATACAA
TATCCTGAAGGTGAAATATATTCTCTTCAATTAGCATAAATATGATTTACATAAGTTAGCTATACAGCTATTGAG
ATAGTACTTTCTAGTAAACTTAAACTACTTTTTAAACATACATTTTGTGTTGATTTAACAAAAATATAGAGAATG
ATTTGCTTTATTGTAATTGTATATAAGTGACTGGAAAAGCACAAAGAAATAAAGTGGGTTCGATCTGTTTACCAA
AAAAAAAAAAAAAAAAAAAAAAAAAAAAAAA
```

FIGURE 74

MSGRAGRRGQDLMGDVYFFDIPFPKIGKLIKSNVPELRGHFPLSITLVLRLMLLASKGDDPEDAKAKVLSVLKHS
LLSFKQPRVMDMLKLYFLFSLQFLVKEGYLDQEGNPMGFAGLVSHLHYHEPSNLVFVSFLVNGLFHDLCQPTRKG
SKHFSQDVMEKLVLVLAHLFGRRYFPPKFQDAHFEFYQSKVFLDDLPEDFSDALDEYNMKIMEDFTTFLRIVSKL
ADMNQEYQLPLSKIKFTGKECEDSQLVSHLMSCKEGRVAISPFVCLSGNFDDDLLRLETPNHVTLGTIGVNRSQA
PVLLSQKFDNRGRKMSLNAYALDFYKHGSLIGLVQDNRMNEGDAYYLLKDFALTIKSISVSLRELCENEDDNVVL
AFEQLSTTFWEKLNKV

FIGURE 75A

```
CTGGCGCGCGCACGCGCACGCGCACGCCCACCGCGCGGCTTCCCCCGCTCCCCGGTGCTGAGGAGAGAGCGATCC
GAGGGACTGCGCCGCCCGGACGGCCTGCAGAGCGCTGCCATCATGAGTGAAATTCGTAAGGACACCTTGAAGGCC
ATTCTGTTGGAGTTAGAATGTCATTTTACATGGAATTTACTTAAGGAAGACATTGATCTGTTTGAGGTAGAAGAT
ACAATTGGGCAACAGCTTGAATTTCTTACCACAAAATCTAGACTTGCTCTTTATAACCTATTGGCCTATGTGAAA
CACCTAAAAGGCCAAAATAAAGACGCCCTTGAGTGCTTGGAACAAGCAGAAGAAATAATCCAGCAAGAACACTCA
GACAAAGAAGAAGTACGAAGCCTGGTCACTTGGGGAAACTATGCCTGGGTGTATTATCACATGGACCAGCTTGAA
GAAGCTCAGAAGTATACAGGTAAGATAGGGAATGTCTGTAAGAAATTGTCCAGTCCTTCTAACTACAAGTTGGAG
TGTCCTGAGACTGACTGTGAGAAAGGCTGGGCACTCTTGAAATTTGGAGGAAAGTATTATCAAAAGGCTAAAGCG
GCTTTTGAGAAGGCTCTGGAAGTGGAGCCTGACAATCCAGAATTTAACATCGGCTATGCTATCACAGTGTATCGG
CTGGATGATTCTGATAGAGAAGGGTCTGTAAAGAGCTTTTCTCTGGGGCCTTTGAGAAAGGCTGTTACCCTGAAC
CCAGATAACAGCTATATTAAGGTTTTTCTGGCACTGAAGCTTCAAGATGTACATGCAGAAGCTGAAGGGGAAAAG
TATATTGAAGAAATCCTGGACCAAATATCATCCCAGCCTTACGTCCTTCGTTATGCAGCCAAGTTCTATAGGAGA
AAAAATTCCTGGAACAAAGCTCTCGAACTTTTAAAAAAGGCCTTGGAGGTGACACCAACTTCTTCTTTCCTGCAT
CACCAGATGGGACTTTGCTACAGGGCACAAATGATCCAAATCAAGAAGGCCACACACAACAGACCTAAAGGAAAG
GATAAACTAAAGGTTGATGAGCTGATTTCATCTGCTATATTTCATTTCAAAGCAGCCATGGAACGAGACTCTATG
TTTGCATTTGCCTACACAGACCTGGCCAACATGTATGCTGAAGGAGGCCAGTATAGCAATGCTGAGGACATTTTC
CGGAAAGCTCTTCGTCTGGAGAACATAACCGATGATCACAAACATCAGATCCATTACCACTATGGCCGCTTTCAG
GAATTTCACCGTAAATCAGAAAATACTGCCATCCATCATTATTTAGAAGCCTTAAAGGTCAAAGACAGATCACCC
CTTCGCACCAAACTGACAAGTGCTCTGAAGAAATTGTCTACCAAGAGACTTTGTCACAATGCTTTAGATGTGCAG
AGTTTAAGTGCCCTAGGGTTTGTTTACAAGCTGGAAGGAGAAAAGAGGCAAGCTGCTGAGTACTATGAAGGCA
CAAAAGATAGATCCAGAAAATGCAGAATTCCTGACTGCTCTCTGTGAGCTCCGACTTTCCATTTAAATACATACT
CTAGGAAATTAGCTCTAAGTTTTTCCCTTCATTTGGGTTCTCCTGTTTGTTTTTTTTTATTATTTTAATCCCT
TGTTTATTATAGAGCTAATATTTATTGAATAGTTATTGTGTACCAAGCATTGTGCTAAATACTTTATATGCATTA
TGATGAATCTTGTGCGGTTTCTTTCTTTTTTCTTTTAATTAAAATACTATAATCCATTGAGAAATAGCAATA
TTCTAGCTATTGTAACTTCTAAAAATGGTATGGCCATTAGATCTGTGCTTTTTATCTCTGCTCTTTGAATTTCTC
ATATTATATAGTAAATATATTCCTACGTAAACCTTTGATACCTAGATCAGGAATACTCTTCCAGGAGTACAAAAT
TACATTATTGATAGTTAAGCTCTTAATTGTGTAGCTTGCAAAAGACAGCACTTTTTAGTTACAGATGTTTTGACT
TTGATGAGGATATTTAGCTATCAATCTAATAGTCACCTAAAATATCTTTTTTGTTGGAAAAAAGTTTATAATAAA
AAAGTTTGTCATCTCTAGTGACTTCAATAAAGAAAAAACTAGAAGAGGAGAAAAAGGATTTCCTCAAATTTTAAA
TATGTAACTTCAGGGATTCAATCCCCAAATGTTTATTAAGTAGCTAGAAATAATTATGTGGAAAAAAATGAATAA
TGGAAAATAGTGAGTCTCAAATTGTTTTTTTTAACTAAAATCTGCAATGAATCTAGATGCAATTAATTTTATTC
CTTCCAACTAAAATTACAATATTTTAGGTTAAAATTATTGAGATATAAAGCAGCCATTGGGAAATTGGGAGAAA
TGATAAACAAATGGAAAAGAAGATGTCCCTAACCTACACCCATAGATTACCAAGGTTTCAGTGTACTAGTTTTG
AATCTGTTCTGAATGGAGTTTTTATACCCTCAATTTCTGGCCTTTGGCTATTTAGCATTTCAAAGTGACTTCTA
TGAAGCTTTTTTTTAATGTGAAATTTTCAGAATGTTGTTTTTTCATGTAGATACTCCAGGAAGAGTTAAGCAC
TGCTTTCAGTTTTAATATCCACCTTGAGGGGTCGCTGCTTGAGGGCTCTTATCCCAGGGGACTTTTAATTCGGA
TGTTACTTAATGTGGCTTCTCTAATGTAGTTTCTTTGATTACCGACTACACAATTATGTACCATCACAGTATTAG
TGGAAAAGTACCATGTGATTTAATTCTCCATTCCTCCAATGTAACTCTTAAAATTATTATGTATGTGTATGTGTT
TTACTTTTGTTTTTATCATCTTTAAAATTCTATTATGGTTTGATTATTATAAAAATAATGAATTCTCACTGT
AAATTTCAAAAAAAAATTACAAAGTATGTGAATTTAAAAATGAGAGCAGTCCCCTCACCCTACCACAGTTCCA
CACCCTCAAGGTAAACTTATAACTTATAATTTGATATGTAAACTTCCAGATCTTTTTCTATGCGTAATCAGACA
TACATATACTGCAGTGTATCTCACGTATTAATTTTTAAAAATCTTTTGTTTTACTTAATTCTGTTTTTATTAT
TATTATTATTTGTTGATCTATTAAGGAAGAACAAGGAAGGGAATGATCTTTACTCAAGAATTTCAGAAAGTCA
GCACTGAAGTCCTGACCTATCAGTAGACACATTTGTCCCTTTCAGATATTTAGGATATTCTAGCAAAGCAGGCC
ATTTCTCCCACCTGAAAGTACATAACTTCTATCACTTGCCACATAATTAAAAGAACTCACATTAAGCGGTTACTC
AGACAGTTAATCATAGAAAAGATTATTTGCTTCATCAGTTCATAGAAAAGATTATTTGCTTCATCAGTTAACTTG
TTTTTATAAATCAGGGCCTGTGTTCATACACAGAAGGGGCCTGAGATTTCTGCACTTTAAACAAGCTCCTCCTAG
GTGAGGATGCTGTGGCTGTTCTAATTACATTTTGAGTAGTAAGGTCTACAGCATTGTTCCTCAAACTTGGCTACG
```

FIGURE 75B

```
TATTGGAATCACCTAAAAAGTTAAAACAAAACATGGATGTCTGGGTCCCGCCCCATAGAGAATGACTTAATTGGC
ATGGGGTGCAGTCCAGGCATCATGATTTTTAGATTTCCCAGTTGGAACTTGTGCAGCAAAGTTTGGGAGCTACTG
ATGGACATGTGAAAAGTAAGTATAAATGGAATAAAATTAATTAGGCTAATAGGCTTAACCCAGGAAATCCTAAGT
TCCTTGAATATCCAGTTTGCATTTGGGACTCCTCATCATATACTTGGTATATAATACTCTAATAAAAGCTGCCTG
AGTTGA
```

FIGURE 76

MSEIRKDTLKAILLELECHFTWNLLKEDIDLFEVEDTIGQQLEFLTTKSRLALYNLLAYVKHLKGQNKDALECLE
QAEEIIQQEHSDKEEVRSLVTWGNYAWVYYHMDQLEEAQKYTGKIGNVCKKLSSPSNYKLECPETDCEKGWALLK
FGGKYYQKAKAAFEKALEVEPDNPEFNIGYAITVYRLDDSDREGSVKSFSLGPLRKAVTLNPDNSYIKVFLALKL
QDVHAEAEGEKYIEEILDQISSQPYVLRYAAKFYRRKNSWNKALELLKKALEVTPTSSFLHHQMGLCYRAQMIQI
KKATHNRPKGKDKLKVDELISSAIFHFKAAMERDSMFAFAYTDLANMYAEGGQYSNAEDIFRKALRLENITDDHK
HQIHYHYGRFQEFHRKSENTAIHHYLEALKVKDRSPLRTKLTSALKKLSTKRLCHNALDVQSLSALGFVYKLEGE
KRQAAEYYEKAQKIDPENAEFLTALCELRLSI

FIGURE 77

```
GCTGACACCTGCCCAGTGGAAGCTGGCATCCCTCCCCTTGTGGGTTCAGAGCTGCAAGAAGCACCAGGCTCGGCC
ACTTCAGAAGCCCCAGCCTCGACCTAGCCCACCCTCTCAGGGCCACAGTGCAGAAGCCTGCACACCTGCCAAGTC
TCTCCGACTCCTTGCAGCTGCTGTCAGCATGGCCCAGGCTCCTGCTGACCCGGGCAGAGAAGGCCACCTTGAACA
AAGAATCCTGCAGGTGCTGACAGAGGCTGGCTCCCCGGTGAAACTTGCCCAGCTGGTGAAGGAATGCCAAGCACC
CAAGAGGGAGCTCAACCAAGTCCTCTACCGAATGAAAAAGGAGTTGAAAGTCTCCCTCACATCCCCTGCCACCTG
GTGCTTGGGCGGGACTGATCCTGAAGGCGAGGGTCCTGCAGAGCTGGCCTTGTCCAGCCCTGCCGAGAGGCCCCA
GCAACATGCAGCTACAATTCCAGAGACCCCTGGCCCTCAGTTCAGCCAACAACGGGAGGAAGACATCTACAGGTT
TCTCAAAGACAATGGTCCCCAGAGGGCCCTGGTCATCGCCCAAGCACTGGGAATGAGGACAGCAAAAGATGTGAA
CCGAGACTTGTACAGGATGAAGAGCAGGCACCTTCTGGACATGGATGAGCAGTCCAAAGCATGGACGATTTACCG
CCCAGAAGATTCTGGAAGAAGAGCAAAGTCAGCCTCAATTATTTACCAGCACAATCCAATCAACATGATCTGCCA
GAATGGACCCAACAGCTGGATTTCCATTGCAAACTCCGAAGCCATCCAGATTGGACACGGGAACATCATTACAAG
ACAGACAGTCTCCAGGGAGGACGGTTCCGCCGGTCCACGCCACCTCCCTTCAATGGCACCAGGTGATTCCTCAAC
TTGGGGGACCCTAGTTGATCCCTGGGGGCCCCAGGACATCCACATGGAGCGGTCCATACTGAGACGGGTGCAGCT
GGGACACAGCAATGAGATGAGGCTCCACGGCGTCCCGTCCGAGGGCCCTGCCCACATCCCCCCTGGCAGCCCCCC
AGTCTCTGCCACTGCTGCCGGCCCAGAAGCTTCGTTTGAAGCAAGAATTCCCAGTCCAGGAACTCACCCTGAGGG
GGAAGCCGCCCAGAGAATCCACATGAAATCGTGCTTTCTCGAGGACGCCACCATCGGCAACAGCAACAAAATGTC
TATCAGCCCAGGGGTGGCTGGCCCAGGAGGAGTCGCAGGGTCTGGAGAGGGGGAGCCAGGGGAGGACGCAGGTCG
TCGTCCCGCAGACACACAATCCAGAAGTCACTTTCCTCGAGACATTGGTCAGCCCATCACTCCCAGCCACTCGAA
GCTCACCCCCAAGCTGGAAACTATGACTCTTGGAAACAGGAGTCACAAAGCTGCAGAAGGCAGCCACTATGTGGA
TGAAGCCTCACACGAGGGGAGCTGGTGGGGAGGTGGGATTTAGTGCACAGCCTCACGTGGGGCTTGGACACAGGC
TGGGGGTGGGCGCATGCTAGGGAGACTAGCCTGCTGCTCTCTGCATTCCTTAGCGTCTTGTTTGACCTGCTTGCT
TCCAGACATAACCTGCATGAATCAGTTTTGGGGGAATGGACCTGGCATGGGGATGGGTTCAGGCCAGGTCTTTTG
ATGGCCAGGAGTAGATGACAGGGAGTTGCCTTGGGGAACCTTTGGTGTGCCAAGAGGAGGTGGGTAGATGGGAGT
GGGGCTCGGTCCCCCAGGCCCAGGGGACTCTCTCCACTCTTTCCTGGGCTCGGGGCATCTGCCTGGAGTTACCTT
CCATCATGGCTACCTGCTGTGGTTTGAATGTTTGAGTCCCAACAAAATTCATATCAAAACATAATCCCAACTGGG
TGCAGTGGCTCACGCCTGTAATCCCAGCACTTTGGGAGGCCGAGGCGGGCGGATCAATAGGTCAGGAAATCCAGA
CCGTCCTGGCTAACATGGTGAAACCCCGTCTCTACTAAAAAAAAAAATACAAAAAATTAGCCGGGCGTTGTGGCG
GGCACCTGGAGTCCCAGCTACTCCGGAGGCTGAGGGAGGAGAATGGTGTGAACCCGGGAGGTGGAGCTTCCAGTG
AGCCGAGATCGCGCCACTGCACTCCAGGCTGGGCGACAGAGCGAGACTCCGTCTCAAAAAAATAAATACATAAAT
AAAAAATAAACCACCCATAAAAAAAAAAAAAAAAAAAAAAAAAAAAAAA
```

FIGURE 78

MAQAPADPGREGHLEQRILQVLTEAGSPVKLAQLVKECQAPKRELNQVLYRMKKELKVSLTSPATWCLGGTDPEG
EGPAELALSSPAERPQQHAATIPETPGPQFSQQREEDIYRFLKDNGPQRALVIAQALGMRTAKDVNRDLYRMKSR
HLLDMDEQSKAWTIYRPEDSGRRAKSASIIYQHNPINMICQNGPNSWISIANSEAIQIGHGNIITRQTVSREDGS
AGPRHLPSMAPGDSSTWGTLVDPWGPQDIHMERSILRRVQLGHSNEMRLHGVPSEGPAHIPPGSPPVSATAAGPE
ASFEARIPSPGTHPEGEAAQRIHMKSCFLEDATIGNSNKMSISPGVAGPGGVAGSGEGEPGEDAGRRPADTQSRS
HFPRDIGQPITPSHSKLTPKLETMTLGNRSHKAAEGSHYVDEASHEGSWWGGGI

FIGURE 79

```
GGACTTTAAAAAATAAACCAAAAAACCCACAATTTCTTCACATCTTTCATGCATTTAATGTTTTGCACAACTTGC
TTGTTTTGCAAATATGCGCACATTTCTATGACAAGATTTATTGCTAAATATTCTTTAAAACTGCAGCAGTTCAGA
TAAGATACTGTCGAAAGGACGTTTGGCCCAGCAGCAGGACCTCCACCAATGAACGGACTCCAATTCTTGATTTGA
GCCTTGGGAACCAATCAACTTTGTTTCCAAGAGTTTATGTGAACTTCCCTCCTTTACCAGTAAAATCTTCCCCCT
ATTCTTCCCTTCTCCAGACCCGTGGCTTGCCATAGCTGTACATCTTGGATTATAATTCTTTTTGTTCACTCCCAA
AGAAACTCAGTATCTTTGGAGAATTCTTTCTTTGTTGTCTTTTAGCTTCCCAGAGCCAAACAAGAAATATTTAG
GTTTTGTGGGTCATGCTGGCTTGGTCACAGCTATTCAACTTGTATCTTAAAATTAGCCATAGACAGTATGAATGG
GTGGGTCTCTGTTCCAATAAAACCTTATCCTAAACACTGAAGTTTGAATTTTATGTAATTTTCAACTGTCATGAA
ATACTCATCTTTTGATCTTTTTCAGCCACTGAAAAATGTAAAAGCCATCCTTAAGTTGCAAGCTATACAAAAACA
GACAGTGGACTGGATTTGACCCTTGAGCCATTTGTCCATGTGCCCTC
```

FIGURE 80

TLKNKPKNPQFLHIFHAFNVLHNLLVLQICAHFYDKIYC

FIGURE 81

```
AGTCTGCACTGGAGCTGCCTGGTGACCAGAAGTTTGGAGTCCGCTGACGTCGCCGCCCAGATGGCCTCCAGGCTG
ACCCTGCTGACCCTCCTGCTGCTGCTGCTGGCTGGGGATAGAGCCTCCTCAAATCCAAATGCTACCAGCTCCAGC
TCCCAGGATCCAGAGAGTTTGCAAGACAGAGGCGAAGGGAAGGTCGCAACAACAGTTATCTCCAAGATGCTATTC
GTTGAACCCATCCTGGAGGTTTCCAGCTTGCCGACAACCAACTCAACAACCAATTCAGCCACCAAAATAACAGCT
AATACCACTGATGAACCCACCACACAACCCACCACAGAGCCCACCACCCAACCCACCATCCAACCCACCCAACCA
ACTACCCAGCTCCCAACAGATTCTCCTACCCAGCCCACTACTGGGTCCTTCTGCCCAGGACCTGTTACTCTCTGC
TCTGACTTGGAGAGTCATTCAACAGAGGCCGTGTTGGGGGATGCTTTGGTAGATTTCTCCCTGAAGCTCTACCAC
GCCTTCTCAGCAATGAAGAAGGTGGAGACCAACATGGCCTTTTCCCCATTCAGCATCGCCAGCCTCCTTACCCAG
GTCCTGCTCGGGGCTGGGCAGAACACCAAAACAAACCTGGAGAGCATCCTCTCTTACCCCAAGGACTTCACCTGT
GTCCACCAGGCCCTGAAGGGCTTCACGACCAAAGGTGTCACCTCAGTCTCTCAGATCTTCCACAGCCCAGACCTG
GCCATAAGGGACACCTTTGTGAATGCCTCTCGGACCCTGTACAGCAGCAGCCCCAGAGTCCTAAGCAACAACAGT
GACGCCAACTTGGAGCTCATCAACACCTGGGTGGCCAAGAACACCAACAACAAGATCAGCCGGCTGCTAGACAGT
CTGCCCTCCGATACCCGCCTTGTCCTCCTCAATGCTATCTACCTGAGTGCCAAGTGGAAGACAACATTTGATCCC
AAGAAAACCAGAATGGAACCCTTTCACTTCAAAAAACTCAGTTATAAAAGTGCCCATGATGAATAGCAAGAAGTAC
CCTGTGGCCCATTTCATTGACCAAACTTTGAAAGCCAAGGTGGGGCAGCTGCAGCTCTCCCACAATCTGAGTTTG
GTGATCCTGGTACCCCAGAACCTGAAACATCGTCTTGAAGACATGGAACAGGCTCTCAGCCCTTCTGTTTTCAAG
GCCATCATGGAGAAACTGGAGATGTCCAAGTTCCAGCCCACTCTCCTAACACTACCCCGCATCAAAGTGACGACC
AGCCAGGATATGCTCTCAATCATGGAGAAATTGGAATTCTTCGATTTTTCTTATGACCTTAACCTGTGTGGGCTG
ACAGAGGACCCAGATCTTCAGGTTTCTGCGATGCAGCACCAGACAGTGCTGGAACTGACAGAGACTGGGGTGGAG
GCGGCTGCAGCCTCCGCCATCTCTGTGGCCCGCACCCTGCTGGTCTTTGAAGTGCAGCAGCCCTTCCTCTTCGTG
CTCTGGGACCAGCAGCACAAGTTCCCTGTCTTCATGGGGCGAGTATATGACCCCAGGGCCTGAGACCTGCAGGAT
CAGGTTAGGGCGAGCGCTACCTCTCCAGCCTCAGCTCTCAGTTGCAGCCCTGCTGCTGCCTGCCTGGACTTGCCC
CTGCCACCTCCTGCCTCAGGTGTCCGCTATCCACCAAAAGGGCTCCTGAGGGTCTGGGCAAGGGACCTGCTTCTA
TTAGCCCTTCTCCATGGCCCTGCCATGCTCTCCAAACCACTTTTTGCAGCTTTCTCTAGTTCAAGTTCACCAGAC
TCTATAAATAAAACCTGACAGACCAT
```

FIGURE 82

MASRLTLLTLLLLLLAGDRASSNPNATSSSSQDPESLQDRGEGKVATTVISKMLFVEPILEVSSLPTTNSTTNSA
TKITANTTDEPTTQPTTEPTTQPTIQPTQPTTQLPTDSPTQPTTGSFCPGPVTLCSDLESHSTEAVLGDALVDFS
LKLYHAFSAMKKVETNMAFSPFSIASLLTQVLLGAGQNTKTNLESILSYPKDFTCVHQALKGFTTKGVTSVSQIF
HSPDLAIRDTFVNASRTLYSSSPRVLSNNSDANLELINTWVAKNTNNKISRLLDSLPSDTRLVLLNAIYLSAKWK
TTFDPKKTRMEPFHFKNSVIKVPMMNSKKYPVAHFIDQTLKAKVGQLQLSHNLSLVILVPQNLKHRLEDMEQALS
PSVFKAIMEKLEMSKFQPTLLTLPRIKVTTSQDMLSIMEKLEFFDFSYDLNLCGLTEDPDLQVSAMQHQTVLELT
ETGVEAAAASAISVARTLLVFEVQQPFLFVLWDQQHKFPVFMGRVYDPRA

FIGURE 83

```
GGGCTTCGTGTTCCTGGGTGCTGACCGTGCACTCCCCGCCGCCCGAGGACTTAGAGCTCTGGAAGTAGCTCTCCA
GCTTCCTTCGTACTCGGGGGCCGGACTTGTACACCCGCACGAGGAGCGGGGACGGCGGGCGCAGAAGTGGGCCAC
CATATCTGGAAACTACAGTCTATGCTTTGAAGCGCAAAAGGGAATAAACATTTAAAGACTCCCCCGGGGACCTGG
AGGATGGACTTTTCCATGGTGGCCGGAGCAGCAGCTTACAATGAAAAATCAGGTAGGATTACCTCGCTCTCACTC
TTGTTTCAGAAAGTCTTTGCTCAGATCTTTCCTCAGTGGAGAAAGGGGAATACAGAAGAATGTCTCCCCTACAAG
TGCTCAGAGACTGGTGCTCTTGGAGAAAACTATAGTTGGCAAATTCCCATTAACCACAATGACTTCAAAATTTTA
AAAAATAATGAGCGTCAGCTGTGTGAAGTCCTCCAGAATAAGTTTGGCTGTATCTCTACCCTGGTCTCTCCAGTT
CAGGAAGGCAACAGCAAATCTCTGCAAGTGTTCAGAAAAATGCTGACTCCTAGGATAGAGTTATCAGTCTGGAAA
GATGACCTCACCACACATGCTGTTGATGCTGTGGTGAATGCAGCCAATGAAGATCTTCTGCATGGGGAGGCCTG
GCCCTGGCCCTGGTAAAAGCTGGTGGATTTGAAATCCAAGAAGAGAGCAAACAGTTTGTTGCCAGATATGGTAAA
GTGTCAGCTGGTGAGATAGCTGTCACGGGAGCAGGGAGGCTTCCCTGCAAACAGATCATCCATGCTGTTGGGCCT
CGGTGGATGGAATGGGATAAACAGGGATGTACTGGAAAGCTGCAGAGGGCCATTGTAAGTATTCTGAATTATGTC
ATCTATAAAAATACTCACATTAAGACAGTAGCAATTCCAGCCTTGAGCTCTGGGATTTTTCAGTTCCCTCTGAAT
TTGTGTACAAAGACTATTGTAGAGACTATCCGGGTTAGTTTGCAAGGGAAGCCAATGATGAGTAATTTGAAAGAA
ATTCACCTGGTGAGCAATGAGGACCCTACTGTTGCTGCCTTTAAAGCTGCTTCAGAATTCATCCTAGGGAAGAGT
GAGCTGGGACAAGAAACCACCCCTTCTTTCAATGCAATGGTCGTGAACAACCTGACCCTCCAGATTGTCCAGGGC
CACATTGAATGGCAGACGGCAGATGTAATTGTTAATTCTGTAAACCCACATGATATTACAGTTGGACCTGTGGCA
AAGTCAATTCTACAACAAGCAGGAGTTGAAATGAAATCGGAATTTCTTGCCACAAAGGCTAAACAGTTTCAACGG
TCCCAGTTGGTACTGGTCACAAAAGGATTTAACTTGTTCTGTAAATATATATACCATGTACTGTGGCATTCAGAA
TTTCCTAAACCTCAGATATTAAAACATGCAATGAAGGAGTGTTTGGAAAAATGCATTGAGCAAAATATAACTTCC
ATTTCCTTTCCTGCCCTTGGGACTGGAAACATGGAAATAAAGAAGGAAACAGCAGCAGAGATTTTGTTTGATGAA
GTTTTAACATTTGCCAAAGACCATGTAAAACACCAGTTAACTGTAAAATTTGTGATCTTTCCAACAGATTTGGAG
ATATATAAGGCTTTCAGTTCTGAAATGGCAAAGAGGTCCAAGATGCTGAGTTTGAACAATTACAGTGTCCCCCAG
TCAACCAGAGAGGAGAAAAGAGAAAATGGGCTTGAAGCTAGATCTCCTGCCATCAATCTGATGGGATTCAACGTG
GAAGAGATGTGTGAGGCCCACGCATGGATCCAAAGAATCCTGAGTCTCCAGAACCACCACATCATTGAGAATAAT
CATATTCTGTACCTTGGGAGAAAGGAACATGACATTTTGTCTCAGCTTCAGAAAACTTCAAGTGTCTCCATCACA
GAAATTATCAGCCCAGGAAGGACAGAGTTAGAGATTGAAGGAGCCCGGCTGACCTCATTGAGGTGGTTATGAAC
ATTGAAGATATGCTTTGTAAAGTACAGGAGGAAATGGCAAGGAAAAAGGAGCGAGGCCTTTGGCGCTCGTTAGGA
CAGTGGACTATTCAGCAACAAAAAACCCAAGACGAAATGAAAGAAAATATCATATTTCTGAAATGTCCTGTGCCT
CCAACTCAAGAGCTTCTAGATCAAAAGAAACAGTTTGAAAAATGTGGTTTGCAGGTTCTAAAGGTGGAGAAGATA
GACAATGAGGTCCTTATGGCTGCCTTTCAAAGAAAGAAGAAAATGATGGAAGAAAAACTGCACAGGCAACCTGTG
AGCCATAGGCTGTTTCAGCAAGTCCCATACCAGTTCTGCAATGTGGTATGCAGAGTTGGCTTTCAAAGAATGTAC
TCGACACCTTGCGATCCAAAATACGGAGCTGGCATATACTTCACCAAGAACCTCAAAAACCTGGCAGAGAAGGCC
AAGAAAATCTCTGCTGCAGATAAGCTGATCTATGTGTTTGAGGCTGAAGTACTCACAGGCTTCTTCTGCCAGGGA
CATCCGTTAAATATTGTTCCCCCACCACTGAGTCCTGGAGCTATAGATGGTCATGACAGTGTGGTTGACAATGTC
TCCAGCCCTGAAACCTTTGTTATTTTAGTGGCATGCAGGCTATACCTCAGTATTTGTGGACATGCACCCAGGAA
TATGTACAGTCACAAGATTACTCATCAGGACCAATGAGACCCTTGCACAGCATCCTTGGAGGGGATTCGCAAGT
GGCAGCCCTGTTGATTAATCTCTACATCATTTAACAGCTGGTATGGCCTTACCTTGGGTGAACTAACCAAATAA
TGACCATCGATGGCTCAAAGAGTGGCTTGAATATATCCCATGGGTTATCTGTATGGACTGACTGGGTTATTGAAA
GGACTAGCCACATACTAGCATCTTAGTGCCTTTATCTGTCTTTATGTCTTGGGGTTGGGGTAGGTAGATACCAAA
TGAAACACTTTCAGGACCTTCCTTCCTCTTGCAGTTGTTCTTTAATCTCCTTTACTAGAGGAGATAAATATTTTG
CATATAATGAAGAAATTTTCTAGTATATAACGCAGGCCTTTTATTTTCTAAAATGATGATAGTATAAAAATGTT
AGGATAACAGAATGATTTTAGATTTTCCAGAGAATATTATAAAGTGCTTTAGGTATGAAAATAAATCATCTTTGT
CTGATTAAAAAAAAAAAA
```

FIGURE 84

MDFSMVAGAAAYNEKSGRITSLSLLFQKVFAQIFPQWRKGNTEECLPYKCSETGALGENYSWQIPINHNDFKILK
NNERQLCEVLQNKFGCISTLVSPVQEGNSKSLQVFRKMLTPRIELSVWKDDLTTHAVDAVVNAANEDLLHGGGLA
LALVKAGGFEIQEESKQFVARYGKVSAGEIAVTGAGRLPCKQIIHAVGPRWMEWDKQGCTGKLQRAIVSILNYVI
YKNTHIKTVAIPALSSGIFQFPLNLCTKTIVETIRVSLQGKPMMSNLKEIHLVSNEDPTVAAFKAASEFILGKSE
LGQETTPSFNAMVVNNLTLQIVQGHIEWQTADVIVNSVNPHDITVGPVAKSILQQAGVEMKSEFLATKAKQFQRS
QLVLVTKGFNLFCKYIYHVLWHSEFPKPQILKHAMKECLEKCIEQNITSISFPALGTGNMEIKKETAAEILFDEV
LTFAKDHVKHQLTVKFVIFPTDLEIYKAFSSEMAKRSKMLSLNNYSVPQSTREEKRENGLEARSPAINLMGFNVE
EMCEAHAWIQRILSLQNHHIIENNHILYLGRKEHDILSQLQKTSSVSITEIISPGRTELEIEGARADLIEVVMNI
EDMLCKVQEEMARKKERGLWRSLGQWTIQQQKTQDEMKENIIFLKCPVPPTQELLDQKKQFEKCGLQVLKVEKID
NEVLMAAFQRKKKMMEEKLHRQPVSHRLFQQVPYQFCNVVCRVGFQRMYSTPCDPKYGAGIYFTKNLKNLAEKAK
KISAADKLIYVFEAEVLTGFFCQGHPLNIVPPPLSPGAIDGHDSVVDNVSSPETFVIFSGMQAIPQYLWTCTQEY
VQSQDYSSGPMRPFAQHPWRGFASGSPVD

FIGURE 85

```
TTCCAGATTAAGTTTTTAACCAGAGTCAAACTTAGCCTTTATAAAAAGTCCTCATTTAATTTCAAAATAGATCTT
CTGTAAGACATGCACATAGGGAAGACCTACCTAGGAATAGCCTGGTGAAATGCAGAATTGGAAAAAGGCAAAAGT
CCTTGCTCATGACTCAGAACTACATCGAGTGAAGTCAGTGTTGAAAACGCCCATTCCCTCCAGGTGAGCCTTCCC
CATTGTGGATTAGTGTTGTGGCTTCATGGCCCTAATAGGGGTGTGTCTGCCAGGAACTGCACTGCATGGGGCCCA
CAGCCCTGCCCCAGAAGCAGCTTTGGTCTCGTTTGCTGAGACCGCTTGCTGTGCCTCATCAATTTCAGGAGGAAA
CAGTGAGATGCCTCTAGATTTTAAATCTGGTTTCGGAGAGCACCTAAGCCCTCTGATGGAATGACTCTCGTAGGA
ACTTGATGGGGTAATTCTAAGGGGGAAGAGCTTGGGAACCGTGAGGGCTGTTAGGCTGCAAGAAGGGAATGGAT
ATGTGAGACCATGTGGGTTTATTTTTTGAAGGGTGAACTGGAGTAGCTGAGGATTCTGCAGTTGACGCCCCAGGA
TGGCTTTGCTCAGCCCTCCCCCGTAGACTGGAGGAAAGCCTACCGCCAAGGGAGGAGAGGATGCATCTGTCCTAG
GTGCAGCCGGCCTCCCTCTTCCAGGTTCAGCAAGGGTCCCTGGCTGGGCATTTTCCTCGTAACCTTTGGCAGCAT
TGGCTCAAATGCCATTGTTTAGATTCCCAGATATTTCCCCACTGCTTTTTGTGTTAAGGTAGTTTGGTAAAATGC
CTTATTCCAATGGCCTAAGATAATATCAAGCAACTCACTGGTTTACTTTTCTAACCAGCTGTGGTTAAGACACAC
ACGGCAATGTGCTATCTTTCACATGTTGGACGTTAAACCCAGACCAACTCCCCAAATCTAATTTGTTTCAGTAAT
TTCTGAATGCATTGACCAAGATATTCCTTTCATCTCTGGTTGAGTTTCTTCCATTAGAAGGAAGGATTAAACCTT
GGATAAAAGATTTGCAGATGCCCCAGTGGTTAGTAGAGGTGAAAATGGAGGTTTCAGGGAAACTGCTGGGGCCTT
TTGCCTTTGTCCTCATCCAAAGCATTTTGTGCCTCTCTTTCTTCTCCTCTGGCTGAATATCCACTGGAGATTGAA
TTCTCCGAAACTCCCTGTGTGGGTGAAGTGGGAAGCTGTGCCCAGGAAGGGGAGTAACTGTGCAAAGTTTTATGC
AGTCAGTGCCAGAATTGGATTACATCACCTGGGGGAGGCGCCTTCAGGACCAGGAAATGGTACATGGAGCTTTGA
GGTGAAAACTCATCTTAGAAACCCACAAAAAGTCATTCCCCCAGCCTGACATCAGGGACAGACCACACCCATGGG
GCAGAAACCGGGCTTGGTTGTTGCAGTGGGAAGAGAAGGCACGACTCTGGTGCACCGAGCACCTTTCCTCGTGGC
TGTTTCCAGGCACTGGGCTGGATGTCCTCAGAACCCCCTGTCCCCTGCCCACTCCTCAAACCCTTACTGACCCAC
CCCTCTCGCCTGGTGCTGTCCCAGGCCCTGGGGGTGAGGGGGAGGGGACTCCAGCGTGGGCTTGCCCTCCAGTGT
GGTGGGAGGGAACCACGTGGCCACTTGGCTTAGCCGTGCTCATGGTGCAGACGTGGAACGCGGAGGCAGGGAGAG
GCTCCGTGACGTCCCCAGGGCCCCAGAACGAGGAAGGAGCGGAGTTGGGATTCCAGCCCAGTTGGACGCTGAAGT
CCCTGTTTTGTTTACTGCCTCCTGTTCATGGCGTATGAATGTATCTGAGATGCTTTGTAAGGCATAAAGTGCAAT
ACTAGCTTAGTGGCTGTTCGTTCAGTGATTCCTTCTGTTACCAAACAGGTGGCTGAGATGAGAGGGCAACCCAAG
CCTAACGCCCTTCAGTGGCCTTGCATCAGAGTACTCGTGACAGGTACCTCTCCGTGGAGAGGGGCTGTCCTCTGC
CCTTGCCTGCTCCTCCTATTGCAACAGTCCTGTGGACTAGCTCAGGCTCTACAGGGGCTGNNNNNNNNNNNNNNN
NNNNNNGTGTATATGTGTCTACCTACACACAAGCACATGTGCACACATGCACACACATGCAGTGCATAGCACACG
CACACTACACACATGCACACACACTCACATGGACACACACTATACACACACATGCACACACATACATGCACACAC
ATGCACATGGACACACATACATGCACACACATACATGCAGGTGTGCAGACTTGGCTCCAGGCGTGTGTTTGATAG
TATTATTCTATGATATTTCCCTCATCTCCATAGAATACCAGCTTCTGAATCCTCAATCAGCCTTTACTGCAAGAA
GAAAAGAAAAACCTCTCTCATTCCAGGTCTGTGGTGCAGATGGGAAGAGTATAGTCAAAACCCATTAAGGCCTTA
GTCAAATGCCAGCCGAATTAGAACGCAATGAACGTTAGACAAAACAACCCAACTGGCCAGGCGGGGAGGCGCAG
AGCGTATAAATATAAAGTTAGATACTTATAAAGAATAAAGACTCTAATAAAATATTTTATATAAAACTTTT
```

FIGURE 86

MRGQPKPNALQWPCIRVLVTGTSPWRGAVLCPCLLLLLQQSCGLAQALQGLXXXXXXXVYMCLPTHKHMCTHAHT
CSA

FIGURE 87

CGGCAGCCAGCTGAGAGCAATGGGAAATGGGGAGTCCCAGCTGTCCTCGGTGCCTGCTCAGAAGCTGGGTTGGTT
TATCCAGGAATACCTGAAGCCCTACGAAGAATGTCAGACACTGATCGACGAGATGGTGAACACCATCTGTGACGT
CTGCAGGAACCCCGAACAGTTCCCCCTGGTGCAGGGAGTGGCCATAGGTGGCTCCTATGGACGGAAAACAGTCTT
AAGAGGCAACTCCGATGGTACCCTTGTCCTTTTCTTCAGTGACTTAAAACAATTCCAGGATCAGAAGAGAAGCCA
ACGTGACATCCTCGATAAAACTGGGGATAAGCTGAAGTTCTGTCTGTTCACGAAGTGGTTGAAAAACAATTTCGA
GATCCAGAAGTCCCTTGATGGGTCCACCATCCAGGTGTTCACAAAAAATCAGAGAATCTCTTTCGAGGTGCTGGC
CGCCTTCAACGCTCTGAGCTTAAATGATAATCCCAGCCCCTGGATCTATCGAGAGCTCAAAAGATCCTTGGATAA
GACAAATGCCAGTCCTGGTGAGTTTGCAGTCTGCTTCACTGAACTCCAGCAGAAGTTTTTTGACAACCGTCCTGG
AAAACTAAAGGATTTGATCCTCTTGATAAAGCACTGGCATCAACAGTGCCAGAAAAAAATCAAGGATTTACCCTC
GCTGTCTCCGTATGCCCTGGAGCTGCTTACGGTGTATGCCTGGGAACAGGGGTGCAGAAAAGACAACTTTGACAT
TGCTGAAGGCGTCAGAACGGTTCTGGAGCTGATCAAATGCCAGGAGAAGCTGTGTATCTATTGGATGGTCAACTA
CAACTTTGAAGATGAGACCATCAGGAACATCCTGCTGCACCAGCTCCAATCAGCGAGGCCAGTAATCTTGGATCC
AGTTGACCCAACCAATAATGTGAGTGGAGATAAAATATGCTGGCAATGGCTGAAAAAAGAAGCTCAAACCTGGTT
GACTTCTCCCAACCTGGATAATGAGTTACCTGCACCATCTTGGAATGTCCTGCCTGCACCACTCTTCACGACCCC
AGGCCACCTTCTGGATAAGTTCATCAAGGAGTTTCTCCAGCCCAACAAATGCTTCCTAGAGCAGATTGACAGTGC
TGTTAACATCATCCGTACATTCCTTAAAGAAAACTGCTTCCGACAATCAACAGCCAAGATCCAGATTGTCCGGGG
AGGATCAACCGCCAAAGGCACAGCTCTGAAGACTGGCTCTGATGCCGATCTCGTCGTGTTCCATAACTCACTTAA
AAGCTACACCTCCCAAAAAAACGAGCGGCACAAAATCGTCAAGGAAATCCATGAACAGCTGAAAGCCTTTTGGAG
GGAGAAGGAGGAGGAGCTTGAAGTCAGCTTTGAGCCTCCCAAGTGGAAGGCTCCCAGGGTGCTGAGCTTCTCTCT
GAAATCCAAAGTCCTCAACGAAAGTGTCAGCTTTGATGTGCTTCCTGCCTTTAATGCACTGGGTCAGCTGAGTTC
TGGCTCCACACCCAGCCCCGAGGTTTATGCAGGGCTCATTGATCTGTATAAATCCTCGGACCTCCCGGGAGGAGA
GTTTTCTACCTGTTTCACAGTCCTGCAGCGAAACTTCATTCGCTCCCGGCCCACCAAACTAAAGGATTTAATTCG
CCTGGTGAAGCACTGGTACAAAGAGTGTGAAAGGAAACTGAAGCCAAAGGGGTCTTTGCCCCCAAAGTATGCCTT
GGAGCTGCTCACCATCTATGCCTGGGAGCAGGGGAGTGGAGTGCCGGATTTTGACACTGCAGAAGGTTTCCGGAC
AGTCCTGGAGCTGGTCACACAATATCAGCAGCTCGGCATCTTCTGGAAGGTCAATTACAACTTTGAAGATGAGAC
CGTGAGGAAGTTTCTACTGAGCCAGTTGCAGAAAACCAGGCCTGTGATCTTGGACCCAGGCGAACCCACAGGTGA
CGTGGGTGGAGGGGACCGTTGGTGTTGGCATCTTCTGGACAAAGAAGCAAAGGTTAGGTTATCCTCTCCCTGCTT
CAAGGATGGGACTGGAAACCCAATACCACCTTGGAAAGTGCCGACAATGCAGACACCAGGAAGTTGTGGAGCTAG
GATCCATCCTATTGTCAATGAGATGTTCTCATCCAGAAGCCATAGAATCCTGAATAATAATTCTAAAAGAAACTT
CTGGAGATCATCTGGCAATCGCTTTTAAAGACTCGGCTCACCGTGAGAAAGAGTCACTCACATCCATTCTTCCCT
TGATGGTCCCTATTCCTCCTTCCCTTGCCTTCTTGGACTTCTTGAAATCAATCAAGACTGCAAACCCTTTCATAA
AGCTGCCTTGCTGAACTCCTCTCTGCAGGAGCCCTGCTTAAAATAGTTGATGTCATCACTTTATGTGCATCTTAT
TTCTGTCAACTTGTATTTTTTTTCTTGTATTTTTCCAATTAGCTCCTCCTTTTCCTTCCAGTCTAAAAAAGGA
ATCCTCTGTGTCTTCAAAGCAAAGCTCTTTACTTTCCCCTTGGTTCTCATAACTCTGTGATCTTGCTCTCGGTGC
TTCCAACTCATCCACGTCCTGTCTGTTTCCTCTGTATACAAAACCCTTTCTGCCCCTGCTGACACAGACATCCTC
TATGCCAGCAGCCAGGCCAACCCTTTCATTAGAACTTCAAGCTCTCCAAAGGCTCAGATTATAACTGTTGTCATA
TTTATATGAGGCTGTTGTCTTTTCCTTCTGAGCCTGCCTTTATCCCCCCACCCAGGAGTATCCTCTTGCCAAAGC
AAAAGACTTTTTCCTTGGCTTTAGCCTTAAAGATACTTGAAGGTCTAGGTGCTTTAACCTCACATACCCTCACTT
AAACTTTTATCACTGTTGCATATACCAGTTGTGATACAATAAAGAATGTATCTGG

FIGURE 88

MGNGESQLSSVPAQKLGWFIQEYLKPYEECQTLIDEMVNTICDVCRNPEQFPLVQGVAIGGSYGRKTVLRGNSDG
TLVLFFSDLKQFQDQKRSQRDILDKTGDKLKFCLFTKWLKNNFEIQKSLDGSTIQVFTKNQRISFEVLAAFNALS
LNDNPSPWIYRELKRSLDKTNASPGEFAVCFTELQQKFFDNRPGKLKDLILLIKHWHQQCQKKIKDLPSLSPYAL
ELLTVYAWEQGCRKDNFDIAEGVRTVLELIKCQEKLCIYWMVNYNFEDETIRNILLHQLQSARPVILDPVDPTNN
VSGDKICWQWLKKEAQTWLTSPNLDNELPAPSWNVLPAPLFTTPGHLLDKFIKEFLQPNKCFLEQIDSAVNIIRT
FLKENCFRQSTAKIQIVRGGSTAKGTALKTGSDADLVVFHNSLKSYTSQKNERHKIVKEIHEQLKAFWREKEEEL
EVSFEPPKWKAPRVLSFSLKSKVLNESVSFDVLPAFNALGQLSSGSTPSPEVYAGLIDLYKSSDLPGGEFSTCFT
VLQRNFIRSRPTKLKDLIRLVKHWYKECERKLKPKGSLPPKYALELLTIYAWEQGSGVPDFDTAEGFRTVLELVT
QYQQLGIFWKVNYNFEDETVRKFLLSQLQKTRPVILDPGEPTGDVGGGDRWCWHLLDKEAKVRLSSPCFKDGTGN
PIPPWKVPTMQTPGSCGARIHPIVNEMFSSRSHRILNNNSKRNFWRSSGNRF

FIGURE 89

```
TGCAGCTAGTGTGTCAACTCAGCGTTTCTCCTCTCGTCCCTGGAAGAGCTAAAGATGGCTGAATTTCTAGATGAC
CAGGAAACTCGACTGTGTGACAACTGCAAAAAAGAAATTCCTGTGTTTAACTTTACCATCCATGAGATCCACTGT
CAAAGGAACATTGGTATGTGTCCTACCTGTAAGGAACCATTTCCCAAATCTGACATGGAGACTCACATGGCTGCA
GAACACTGTCAGGTGACCTGCAAATGTAACAAGAAGTTGGAGAAGAGGCTGTTAAAGAAGCATGAGGAGACTGAG
TGCCCTTTGCGGCTTGCTGTCTGCCAGCACTGTGATTTAGAACTTTCCATTCTCAAACTGAAGGAACATGAAGAT
TATTGTGGTGCCCGGACGGAACTATGTGGCAACTGTGGTCGCAATGTCCTTGTGAAAGATCTGAAGACTCACCCT
GAAGTTTGTGGGAGAGAGGGGGAGGAAAAGAGAAATGAGGTTGCCATACCTCCTAATGCATATGATGAATCTTGG
GGTCAGGATGGAATCTGGATTGCATCCCAACTCCTCAGACAAATTGAGGCTCTGGACCCACCCATGAGGCTGCCG
CGAAGGCCCCTGAGAGCCTTTGAATCAGATGTTTTCCACAATAGAACTACCAACCAAAGGAACATTACAGCCCAG
GTTTCAATTCAGAATAATCTGTTTGAAGAACAAGAGAGGCAGGAAAGGAATAGAGGCCAACAGCCCCCCAAAGAG
GGTGGTGAAGAGAGTGCAAACTTGGACTTCATGTTGGCCCTAAGTCTGCAAAATGAAGGCCAAGCCTCCAGTGTG
GCAGAGCAGGACTTCTGGAGGGCCGTATGTGAGGCCGACCAGTCTCATGGCGGTCCCAGGTCTCTCAGTGACATA
AAGGGTGCAGCTGACGAGATCATGTTGCCTTGTGAATTTGTGAGGAGCTCTACCCAGAGGAACTGCTGATTGAC
CATCAGACAAGCTGTAACCCTTCACGTGCCTTACCTTCACTCAATACTGGCAGCTCTTCCCCCAGAGGGGTGGAG
GAACCTGATGTCATCTTCCAGAACTTCTTGCAACAGGCTGCAAGTAACCAGTTAGACTCTTTGATGGGCCTGAGC
AATTCACACCCTGTGGAGGAGAGCATCATTATCCCATGTGAATTCTGTGGGGTACAGCTGGAAGAGGAGGTGCTG
TTCCATCACCAGGACCAGTGTGACCAACGCCCAGCCACTGCAACCAACCATGTGACAGAGGGGATTCCTAGACTG
GATTCCCAGCCTCAAGAGACCTCACCAGAGCTGCCCAGGAGGCGTGTCAGACACCAGGGAGACCTGTCTTCTGGT
TACCTGGATGATACTAAGCAGGAAACAGCTAATGGGCCCACCTCCTGTCTGCCTCCCAGCCGACCCATTAACAAT
ATGACAGCTACCTATAACCAGCTATCGAGATCAACATCAGGCCCCAGACCTGGGTGCCAGCCCAGCTCTCCTTGT
GTGCCGAAGCTCAGCAACTCAGACAGCCAGGACATCCAGGGGCGGAATCGAGACAGCCAGAATGGGGCCATAGCC
CCTGGGCACGTTTCAGTGATTCGCCCTCCTCAAAATCTCTACCCAGAAAACATTGTGCCCTCTTTCTCCCCTGGG
CCTTCAGGGAGATACGGAGCTAGTGGTAGGAGTGAAGGTGGCAGGAATTCCCGGGTCACCCCTGCAGCTGCCAAC
TACCGCAGCAGAACTGCAAAGGCAAAGCCTTCCAAGCAACAGGGAGCTGGGGATGCAGAAGAGGAAGAGGAGGAG
TAATGGTGTCTCCAGAGACTTTACATCGGTTCCTGTCTTCTGTGCACAGCAGCACTTGCCGCTGTGCAGGCCCAC
CTCTTTGGCTCTTTGGGTGGGAGAGTTTTTCCAGATTTTAGATTTTTCTAGGTTATGGCCATTTTGTGTCTTTTG
AGGTTGTGCTGTGGGGGTTTGGGTTTGAGGGAAGGGAGCAGGGTGGCGGTTGAGGAACGCTTCAGCCTTAGCTGC
TACCTTTCGGCAGCAGTGAAATACAAGCTGCAGCCTCGGCTGCCAGGGCTCCCTTTTGACTTATTGTCGCCACTG
CCCCTTGGTGCTGTGTGGTCCCAGTGGAAGGAGGGGAAGATTTTGGAAACCTGGTAGCCACCAGTAAGGTGATTC
TCTGCCCTGTTGGGGCCTAAATTTGGGGGCTTTTGGGCAACCTCTCCGTGTACTGCGTCTGTCCACACTCGATTG
GGCCCCAGGTGTGTATGAGGCGCTCTGGTAAGGTGCTCAGGCCAGTTGCAATGTCTGTCAGTAACGAGGCTTTTG
ATGTGTTGAGCTGGAGGTGAGTGGACCGGGGGCTGTGTTTAAGCTGCTTCCTTGGCATTTGCATCACTGCCTTC
TGTTCCCGGGGGAGCATGGATCTTTTGTCCTCACTGCTTTCTAATGGGGAGGGCTGAGGGCTCCCTGTCCCCACA
GCAGGTATGTTTGCTCTGCCCCAGCCCCACACTTGCTCTGAAAACCAAGTGTCAGAGCCCCTTCCCCTTGTTTTT
ATTTTACTGTTATAATAATTATTAACTTCCTTGTAATAGAAATAAAGTTTGTACTTGGAGTTCAGCTC
```

FIGURE 90

MAEFLDDQETRLCDNCKKEIPVFNFTIHEIHCQRNIGMCPTCKEPFPKSDMETHMAAEHCQVTCKCNKKLEKRLL
KKHEETECPLRLAVCQHCDLELSILKLKEHEDYCGARTELCGNCGRNVLVKDLKTHPEVCGREGEEKRNEVAIPP
NAYDESWGQDGIWIASQLLRQIEALDPPMRLPRRPLRAFESDVFHNRTTNQRNITAQVSIQNNLFEEQERQERNR
GQQPPKEGGEESANLDFMLALSLQNEGQASSVAEQDFWRAVCEADQSHGGPRSLSDIKGAADEIMLPCEFCEELY
PEELLIDHQTSCNPSRALPSLNTGSSSPRGVEEPDVIFQNFLQQAASNQLDSLMGLSNSHPVEESIIIPCEFCGV
QLEEEVLFHHQDQCDQRPATATNHVTEGIPRLDSQPQETSPELPRRRVRHQGDLSSGYLDDTKQETANGPTSCLP
PSRPINNMTATYNQLSRSTSGPRPGCQPSSPCVPKLSNSDSQDIQGRNRDSQNGAIAPGHVSVIRPPQNLYPENI
VPSFSPGPSGRYGASGRSEGGRNSRVTPAAANYRSRTAKAKPSKQQGAGDAEEEEEE

FIGURE 91

```
CCGAGCGCCAGCGCGGGGAACCGGGAAAAGGAAACCGTGTTGTGTACGTAAGATTCAGGAAACGAAACCAGGAGC
CGCGGGTGTTGGCGCAAAGGTTACTCCCAGACCCTTTTCCGGCTGACTTCTGAGAAGGTTGCGCACAGCTGTGCC
CGGCAGTCTAGAGGCGCAGAAGAGGAAGCCATCGCCTGGCCCCGGCTCTCTGGACCTTGTCTCGCTCGGGAGCGG
AAACAGCGGCAGCCAGAGAACTGTTTTAATCATGGACAAACAAAACTCACAGATGAATGCTTCTCACCCGGAAAC
AAACTTGCCAGTTGGGTATCCTCCTCAGTATCCACCGACAGCATTCCAAGGACCTCCAGGATATAGTGGCTACCC
TGGGCCCCAGGTCAGCTACCCACCCCCACCAGCCGGCCATTCAGGTCCTGGCCCAGCTGGCTTTCCTGTCCCAAA
TCAGCCAGTGTATAATCAGCCAGTATATAATCAGCCAGTTGGAGCTGCAGGGGTACCATGGATGCCAGCGCCACA
GCCTCCATTAAACTGTCCACCTGGATTAGAATATTTAAGTCAGATAGATCAGATACTGATTCATCAGCAAATTGA
ACTTCTGGAAGTTTTAACAGGTTTTGAAACTAATAACAAATATGAAATTAAGAACAGCTTTGGACAGAGGGTTTA
CTTTGCAGCGGAAGATACTGATTGCTGTACCCGAAATTGCTGTGGGCCATCTAGACCTTTTACCTTGAGGATTAT
TGATAATATGGGTCAAGAAGTCATAACTCTGGAGAGACCACTAAGATGTAGCAGCTGTTGTTGTCCCTGCTGCCT
TCAGGAGATAGAAATCCAAGCTCCTCCTGGTGTACCAATAGGTTATGTTATTCAGACTTGGCACCCATGTCTACC
AAAGTTTACAATTCAAAATGAGAAAAGAGAGGATGTACTAAAAATAAGTGGTCCATGTGTTGTGTGCAGCTGTTG
TGGAGATGTTGATTTTGAGATTAAATCTCTTGATGAACAGTGTGTGGTTGGCAAAATTTCCAAGCACTGGACTGG
AATTTGAGAGAGGCATTTACAGACGCTGATAACTTTGGAATCCAGTTCCCTTTAGACCTTGATGTTAAAATGAA
AGCTGTAATGATTGGTGCCTGTTTCCTCATTGACTTCATGTTTTTTGAAAGCACTGGCAGCCAGGAACAAAAATC
AGGAGTGTGGTAGTGGATTAGTGAAAGTCTCCTCAGGAAATCTGAAGTCTGTATATTGATTGAGACTATCTAAAC
TCATACCTGTATGAATTAAGCTGTAAGGCCTGTAGCTCTGGTTGTATACTTTTGCTTTTCAAATTATAGTTTATC
TTCTGTATAACTGATTTATAAAGGTTTTTGTACATTTTTAATACTCATTGTCAATTTGAGAAAAAGGACATATG
AGTTTTTGCATTTATTAATGAAACTTCCTTTGAAAAACTGCTTTGAATTATGATCTCTGATTCATTGTCCATTTT
ACTACCAAATATTAACTAAGGCCTTATTAATTTTTATATAAATTATATCTTGTCCTATTAAATCTAGTTACAATT
TATTTCATGCATAAGAGCTAATGTTATTTTGCAAATGCCATATATTCAAAAAAGCTCAAAGATAATTTTCTTTAC
TATTATGTTCAAATAATATTCAATATGCATATTATCTTTAAAAAGTTAAATGTTTTTTAATCTTCAAGAAATCA
TGCTACACTTAACTTCTCCTAGAAGCTAATCTATACCATAATATTTTCATATTCACAAGATATTAAATTACCAAT
TTTCAAATTATTGTTAGTAAAGAACAAAATGATTCTCTCCCAAAGAAAGACACATTTTAAATACTCCTTCACTCT
AAAACTCTGGTATTATAACTTTTGAAAGTTAATATTTCTACATGAAATGTTTAGCTCTTACACTCTATCCTTCCT
AGAAAATGGTAATTGAGATTACTCAGATATTAATTAAATACAATATCATATATATATTCACAGAGTATAAACCTA
AATAATGATCTATTAGATTCAAATATTTGAAATAAAAACTTGATTTTTTGT
```

FIGURE 92

MDKQNSQMNASHPETNLPVGYPPQYPPTAFQGPPGYSGYPGPQVSYPPPPAGHSGPGPAGFPVPNQPVYNQPVYN
QPVGAAGVPWMPAPQPPLNCPPGLEYLSQIDQILIHQQIELLEVLTGFETNNKYEIKNSFGQRVYFAAEDTDCCT
RNCCGPSRPFTLRIIDNMGQEVITLERPLRCSSCCCPCCLQEIEIQAPPGVPIGYVIQTWHPCLPKFTIQNEKRE
DVLKISGPCVVCSCCGDVDFEIKSLDEQCVVGKISKHWTGILREAFTDADNFGIQFPLDLDVKMKAVMIGACFLI
DFMFFESTGSQEQKSGVW

FIGURE 93A

```
GTCGACCTGCAGGTCAACGGATCTGAGAGGAGAGTAGCTTCTTGTAGATAACAGTTGGATTATATACCATGTCCT
GATCCCCTTCATCATCCAGGAGAGCAGAGGTGGTCACCCTGATAGCAGCAAGCCTGGGGGCTGCAGCTTGGTGGG
TAGAGGTACTCAGGGGTACAGATGTCTCCAAACCTGTCCTGCTGCCTTAGGGAGCTTCTAATAAGTTGATGGATT
TGGTTAAAATTAACTTGGCTACTTGGCAGGACTGGGTCAGTGAGGACCAACAAAAAGAAGACATCAGATTATACC
CTGGGGGTTTGTATTTCTTGTGTTTCTTTCTCTTCTTTGTACTAAAATATTTACCCATGACTGGGAAAGAGCAAC
TGGAGTCTTTGTAGCATTATCTTAGCAAAAATTTACAAAGTTTGGAAAACAATATTGCCCATATTGTGTGGTGTG
TCCTGTGACACTCAGGATTCAAGTGTTGGCCGAAGCCACTAAATGTGAGATGAAGCCATTACAAGGCAGTGTGCA
CATCTGTCCACCCAAGCTGGATGCCAACATTTCACAAATAGTGCTTGCGTGACACAAATGCAGTTCCAGGAGGCC
CAAATGAAAATGTTTGTACTGAAATTTGTTAAAGCTTCCCGACAAACTAGATTTATCAGTAAGGATTGTTTTCTG
CAAGGGGGATGAAACTTGTGGGGTGAGCCATTGGGCTGAGGAGGAGGGAGGTTGGAGCTGAGAAATGTGGAGAC
AATTTCCCTTTAGAAGGACTGAATCTCCCTGCCTCTCTGGGGTGCGGCAGCCAGCAGGATCCAATGGTGTATATG
TCTCCCCAGCTCCCCATTCAGTGATATCATGTCAGTAGCTTGAAATTATCCGTGGTGGGAGTATTATGTCATGGA
AATTGGCAAATGGAAACTTTTATTGGAGATTCAATTGTTAAACTTTTACCAGCACAACACTGCCCTGCCTTCAGA
GTCAATGACCCTATCCAAGTTTAATCCATCTGTCCACTGTCTCCAACACGATCTTTATAAAACACACCTGACAAC
ATTACCCTTTTATTCAGTTTTTTAAAAGATAAGTTTCCAGCTCATCGGGGTGGCTTTAAAGGCCATTTCTCCTCT
GGACCTCACCCAACTTTTCAAATCACTTTTCCTACCCCTACCTCTAAATGCTACTCAAACTCCAGCCATCCTGAA
TAATAAGACTTTTGAAAAGTAGATTATGGGCTGGGCACAGTGGCTCACACCTGTAATCCCAGCACTTTGGGAGGC
CAAGATGGGTGGATCACCTGAGGTCGGGAGTTCGAGACCAGCCTGACTAACATAGTGAAACCCTGTCTCTACTAA
AAATACAAAATTAGTTGGGGGTGGTGGCACAAGCCTGTAATCCCAGCTACTCAGGAGGTTGAGGCAGGGGAATTG
CTTGAACCTGGGAGGCGGAGGTTGCGGTGAGCCTAGATTGCTCCACTGCACTCCAGCCTGGGCAACAAGAGCGAA
ACTCCATCTCAAAAAAATAAATAAATAAATAAAGTAGATTACATCAGATACCTCTGGCCTAGGTTGTTTATGACC
AACTCTCCTGCTGAGAATAACTAGAAAAGCTAGACAAAACATATTTCCAAAAGATCTCTTTGGAGGCATCAGAGA
ATGGCCAAGGCTGTAAGGAACTGCCTGAGCCCAGAGAGGTGGAGCCCAGCACTGGTGCCCTTTACTCCTGGGGAC
ATGTGCTGGTTTCAAAAACTTCAGCTGAGCTTTTGAGCATTCATGGAACTTGGTGGGGGAGATGAAATTTGTACC
TTAAATCCTGCCTACAGGGAGGGTCCCTGATAATCCCCACCCAATTTGGAAATCTGGGTCAGCCTTCACAGGTAC
TGAAGCCCTCCTCTGAATGATCTCAAGTCCTGCTAGGGTAGAGGTTACCTGCTTTTGAAAGGCTCCTGGCCTACC
TGTGCAGCAGGAGCAAAAGTGAACCATCTCAGGGTACAGATAACAATCATCCAGAGCCTTGAATGACCTCTACTG
TGCTTAATATATAGTATTCAGCAGTCAGTAAAAAGGATTTAGGCACATGCAAGATGACCTGTGTATCAGGGAGAA
ATAGGCAATAAATTGAGATCCAGCAGGGATTTGAATCATGGATTTGAATCAGGGGCAGCCTTCGAAAGAACTATG
GAGAATATACTCAGATTTAAAACATAAGATTGGAATTTTTGGCAGAGAACTAACAACTGTACAAAAAAGGAACCA
AATGGAAATCCTAGAACTGAAAGATGCAATTAACCGATGTTGAGAAATAGCCAACATCTATTGAACACTTCCCAT
GTGGACAGCTGTGCTAAACACTTTACAGGCATCAACATAAGATGTGTCCCCTTACAGCAGTGCAGTGTCCCTCCT
AAGACATGGACAGCCTGGTTTCCCTATCTCTCTGCTTCATCAAAACCCCTTTACGTGGGGCTTAGACACTCCTGT
TGTCTCTAGTGTCTAGTAGCACAGGGCTCAGCACATGGAAGCCACTAGATACAATTGATGACCAGGACCTCCGA
TGAAAGCCATGGGTGCTGATTGGGAAGGCATTGTCTTTTATGTGCTATGGTCTTAAAGCTTCATCCAGGAAGCAG
AACTCGGGGGGTGCTGAGGACCCAGAACCGAGAATAAGATTAGTCAGAGATTTCCTGTGGGCAGAAATCATAAGG
ACGCCAACTGTTTGGGTGAGATAAGACGAAACCAAGAGTGGACTTGTGGCCAGAAGCGTGAGGAAGAGGGAGAGA
GCTTCCCTTGTCCCCTTTCTTCCTCTCCCTAAGCCACAGTGATTGACAGCCCCCCGCTTTGGAGTCAGAGCAGG
CTTGAGACTGGACTGGGAAAGGAGGGTGGGTCAGGATACAGAGCAGGAAGGCTGGGAGTGCAGGGCAGGAGCAAG
GGGCTGGGCATTCATTGTGCCTGATCTCTCCCACTTTACCTGGGGTAAAGAAGCATATGCAAAAGCCACGGTGT
GAGTATTTCCCAAGTGCCAGGGTCAGGGCATGATTCATCACGTGCAGCATTTCATTCAATCCTTATAGTAACCGA
TGATGTGGCTTCTATTATTAGCTCTATCAGATAATGAAACTGAGACCAAGACAGGCTCTGCACATTGTGTGGGGT
AATGACACAGGGGGATTCAGACCTAGACTCCATAACTCCTGCCCCAGGGACCACCCCCACCCTCACCCTGTGCAT
GTCGACAAAGGACAGACTGGGCCACTTCTCAGGACACAGCGGGGAAATGACACAGAGCAGGGAGGTTCCAGGAGC
CCCGAGCGTCTTTTCTCCAGGAGAATACTCTCTGAATTCAGACTGGGGTCAGAGAAACATTTACCCAGGAGCCGC
AGTGTGGGTGGGGCTTTTTACTTGAAACGCTGTCTGAAGGCAGTGGCAGGATGAACTCTCCACCCTACCTTGGCA
AGCCACTTCTCTTCTGCAATCTGTAAGGACATTGTTGAGAGAATTATGGTCTTCCAATTCCGGAGGGTTGAAGAA
AGACAAATAGGAGAGAACCTATCATAGTCAGGTGCTAGCTGCCTTCTCTTTCAGAGAGTGTGAGAATAAAGTGAT
```

FIGURE 93B

```
ACACTTGATTATTAGCAAATACTTTGGAAATTTTAAACGCTAATATTCAACACACTCTGGAAGAGGCAAATAAGT
AGACAGGTTCATATACATCATCTCCTTCAGCTAGTCCTCACAAAAACAAACAAATGAATAAACAAAATTCTTCTT
TGGCCCTCATAGGAAGACACTGTTTCTTGAACGTGTTTCAAAAAGGATGGGTGACTCACTCAAGGTCACACTGTT
TATGAGGACAGTACAGGAATACAGACATGCCATTTTGCCTGAAAAAATCCATCACCCAGGGAGGTGACACAATTT
TGCAGAAATGTTCTATTTCCTCTGAAGGATACATTCTTTAAACCTTTGGGAAATTCATTCATAGTCTTCCTCCTT
TGAAGGATTACTCTCTGGACACAAAGTGTTTGATTCTGATTTGTTGGTTGGAAGATGTGTTGGTTGAGAGAAAGA
TTCTGATTTGTTGGTTGAAAATAGACTCATCAAGATCAACTGCTGTAGTAGTAAATATTTTGACATTTGTCTGT
ATTCCTGTGCTGCCCTCACAAGCTGCATCACCTTGAGTGAGTCATTCATACTTTTTGTTTGTTTTGTTTTGGA
GATGGAGTCTTACTCTGTTGCCTAGGCTGGAGTGCGGTGGCGTGATCTTGGCTCACTGCGACCTCCATCTCCTGG
GTTCAAGTGATCCTCCTGCCTCAGCCTCCCGAGTAGCTGGGATTACAGGCACATGCCACCATCCCTGCTAATTTT
TGCATTTTCAGTAGAGACGGAGTTTCACCATGTTGGTCAGGTTGGTCTTGAACTCCTGACCTCAGGTGATCCGCC
CACCTCAGCCTCCCCAAGTGCTGGGATTACAGGTGTGAGCCACCGTGCCCAGCCCAGCCATCATTTTGAAACAC
GTTTGAGAAATAGTGTCTTCCTTTGAGGGCCAAGGAGACATTTTTTTGTTTATTTGTTTGTTTTGTGAGGACT
AGCTGAAGGGGGTGATGTATATTAACCTGCCTACTTATTTGCCTCTTCCCAGAGTGTGATGAATATTAGGGTTTA
AAGTTTCTGAAGCATTTGTTAATAAAGCCCGGGGCTGGAGGTCAGAAGACCTGGATTTCTCTGCATACTTTTGCC
ATCAGCAAGCTGTGTGACCTTGGACAGATCCCTTTTTGTCTAAATCTTTCTGAGTCTTCTTGAAAACAATGCCA
GGTTGGGACAGGATGATTGCCAAGCTCCCGTCCAGCTCTAAAACACTGCAACGTATGCTTCTGCACCAGCACTGT
CCATCCTGTAGATCATGCAGAAATTCTCTTCAACTTTTTCCTACCCATAAAATAGGAGCATGCTTACCTTTTCC
TAATGTTCCAGGCCCCGGGTCTAGATATTGTAAGTAAGGAAGTTAATGTGTATCAGAGCCCATTATGGGCCAGAA
GTTCTCCTCTTCCTTCCTACACCTGCTTCCTCCCTCCCTCCCTCCCTCTTTCCCTTCCTTCCTTCCATCCATTTG
TGAAGAAGACATGATCACCCTCATTCTGAGAGTGAAGAGACAGAGGCTCAACTAATGAAATGATTTGTTCAAGGT
CACACGGGTGGCACAAGGCAAGTGGCAGAGGTTGAATTTAGACCCATTCCTGTCCAAATGCTGAGTTTATGTCAT
CGTCCCGAGACCATAACTTTAAAGATGTAAGATAGTGGGAAAAGAGTTGATTTCAAAGCACCTCTCAGAAGGACT
CACTTTACATCAGGGGTCAGCAGACTCAGGCCAAATCCGGTCCATTCCCCGCTTTTGCAAAGAAAGTTGTAGTGG
AACACAGCTAGGCTTATTGATTTATGGATTGCCAACGTCCTTTTGTGAAACAGACAGCTGAGCTGAGTAATCGTG
GCGCACAAAACCTAAAATATTTACTATCTCGTCCTTTACAGAATGTTTGCCAATCTATGGTCCGGAGTCCAAGGC
TGTCCATTTTTCAAAGAACACAAAGTGACATGAGACTGTCCCATGTGCAGGGAGCCCTATCATTTTATTATGAAA
AAACGGCCTTTCTGCTCAAATCTGTTTTTAAAAAGTCAACAAACAGACTCTGGGTACCTGTCAGGAACAGTAGG
GAGTTTGGTTTCCATTGTGCTCTTCTTCCCAGGAACTCAATGAAGGGGAAATAGAAATCTTAATTTTGGGGAAAT
TGCACAGGGGAAAAAGGGGAGGGAATCAGTTACAACACTCCATTGCGACACTTAGTGGGGTTGAAAGTGACAACA
GCAAGGGTTTCTCTTTTTGGAAATGCGAGGAGGGTATTTCCGCTTCTCGCAGTGGGGCAGGGTGGCAGACGCCTA
GCTTGGGTGAGTGACTATTTCTTTATAAACCACAACTCTGGGCCCGCAATGGCAGTCCACTGCTTGCTGCAGTCA
CAGAATGGAAATCTGCAGAGGCCTCCGCAGTCACCTAATCACTCTCCTCCTCTTCCTGTTCCATTCAGAGACGAT
CTGCCGACCCTCTGGGAGAAAATCCAGCAAGATGCAAGCCTTCAGGTAAGGCTACCCCAAGGAGGAGAAGGTGAG
GGTGGATCAGCTGGAGACTGGAAACATATCACAGCTGCCAGGGCTGCCAGGCCAGAGGGCCTGAGAACTGGGTTT
GGGCTGGAGAGGATGTCCATTATTCAAGAAAGAGGCTGTTACATGCATGGGCTTCAGGACTTGTGTTTCAAAATA
TCCCAGATGTGGATAGTGCGACCGGAGGGCTGTCTTACTTTCCAGAGACTCAGGAACCCAGTGAGTAATAGATG
CATGCCAAGGAGTGGGACTGCGATTCAGGCCTAGTTGAATGTGCTGACAGAGAAGCAGAGAGGGGCACCAGGGGC
ACAGCCCGAAGGCCCAGACTGATATGGGCAAGGCCTGTCTGTGCTGACATGTCGGAGGGTCCCACTCTCCAGGGA
CCTTGGTTTCCCCGTCTGTGACATCTGTGACATGAGAGTCACGATAACTCCTTGTGTGCCTTACAGGGTTGTTGT
GAAAATTAAATGCACAGATAATAGCGTAACAGTATTCCGTGCATTGTAAAGAGCCTGAAAACCATTATGATTTGA
AAATGGAATCGGCTTTGTGAGACCATCACTATTGTAAAGATGTGATGCTGATAGAAATGACAGGACTGCTTGTGC
ATGCCCTCTGCAGTGTGACATTCCAGCAGTGAAATCATGTTGGGGTGACTTCTCCCCCACTCTGACCTTTATGTT
TGTCTGGGCCGAGGCTGCAAGTCGGGCTCTGTGGGTGTATGAGTGACAAGTCTCTCCCTTCCAGATATGGGGACT
GTCTGCTTCCCTAGGTTGCCTCTCCCTGCTCTGATCAGCTAGAAGCTCCAGGAGATCCTCCTGGAGGCCCAGCA
GGTGATGTTTATCCCTCCAGACTGAGGCTAAATCTAGAAACTAGGATAATCACAAACAGGCCAATGCTGCCATAT
GCAAAGCACTTTGGTTTGCCTGGCCACCCCTCGTCGAGCATGTGGGCTCTTCAGAGCACCTGATGAGGTGGGTAC
AGTTAGCCACACTTCACAGGTGAAGAGGTGAGGCACAGGTCCCAGGTCAGGCTGGCCGGAGCTCTGTTTATTACG
```

FIGURE 93C

```
TCTCACAGCTTTGAGTCCTGCTCTCAACCAGAGAGGCCCTTTACCAAGAAGAAAGGATTGGGACCCAGAATCAGG
TCACTGGCTGAGGTAGAGAGGAAGCCGGGTTGTTCCCAAGGGTAGCTGCTCCTGCAGGACTCTGAGCAGGTCACC
AGCTAATGGAGGAAAGGCTCTAGGGAAAGACCCTTCTGGTCTCAGACTCAGAGCGAGTTAGCTGCAAGGTGTTCC
GTCTCTTGAAACTTCTACCTAGGTGCTATGGTAGCCACTAGTCTCAGGTGGCTATTTAAATTTATACTTAAATGA
ATGAAAATAGAAGAAAATTTAAAATCCAGACCCTTGGTCACACTATCCACATTTAAAGAGGTCAATAGCCACATG
TGGTTAGTGGCCACCCTATTGGGCAGTGCAGCTACAGAACATTTTTGCATCCCAGAAAGTTCTTTTGGATGTTGC
TGCTCTACAGCATGCTTTGCTGAAACAGAAGTGCCTTCCCTGGGAATCTCAGATGGGAAGCAAGTAAGGAGGGGA
GTCAAATGTGGGCTCACTGCTCACCAGCTGTGAGGGTTGGGCCTGCCTCTTAACCATTGTCAGCCTCAGTCTTCT
CATCCATGCATGCCGTGGGTATACTAAAATACTATACCCCTGGAAGAGCTGGATGCAAATTTGACAAGTTCTGGG
GGACACAGGAAGGTGCCAAGCACAAGGCTGGGCACATGGTGGCTGTGCACTACAGCTGAGTCCTTTTCCTTTTCA
GAATCTGGGATGTTAACCAGAAGACCTTCTATCTGAGGAACAACCAACTAGTTGCTGGATACTTGCAAGGACCAA
ATGTCAATTTAGAAGGTGAGTGGTTGCCAGGAAAGCCAATGTATCTGGGCATCACGTCACTTTGCCCGTCTGTCT
GCAGCAGCATGGCCTGCCTGCACAAACCCTAGGTGCAATGTCCTAATCCTTGTTGGGTCTTTGTATTCAAGTTTG
AAGCTGGGAGGGCCTGGCTACTGAAGGGCACATATGAGGGTAGCCTGAAGAGGGTGTGGAGAGGTAGAGTCTAGG
TCAGAGGTCAGTGCCTATAGGCAAGTGGTCCCAGGGCCACAGCTGGGAAGGGCAAATACCAGAAGGCAAGGTTGA
CCATTCCCTTCCTCAAGTGCCTATTAAGGCTCCATGTTCCTATGTTGTTCAAACCCTAACTCAATCCCAAATTAA
TCCACCATGTATAAGGTTGAGCTATGTCTCTTATTCCTGGACACCATACTCAGCCATATCTGGTCCACACATTAA
CAGCTGGATGACCTTGAAGAAGCTTCACCCACTCTGTTCCTCAGCTTTCCCTTCAGTGGGATGATATCAACTGGA
CAACAGGATGTGCGATTCTTTTAGTTCCAGCCTTCCAGGATGTTTTCACTCCCCTGTTTGTTGTTAGGATGGT
ATTACCTCCACCTTCCCACCTTCCCTATGCCCTGGTTCTGTCTCCTGTGCCTCGCTCTGAAAGTGGATGAGACCT
ACAATTCCTGTCCTGGTAGTTCTCCTAATGAACACACTGAAGCACGAGGAAGCTGAGATTTTTGTTGCTACATGA
GAGCATGGAGGCCTCTTAGGGAGAGAGGAGGTTCAGAGACTCCTAGGCTCCTGGTGGAGCCCCACTCATGGCCTT
GTTCATTTTCCCTGCCCCTCAGCAACACTCCTATTGACCTGGAGCACAGGTATCCTGGGGAAAGTGAGGGAAATA
TGGACATACATGGAACAACATCCAGGAGACTCAGGCCTCTAGGAGTAACTGGGTAGTGTGCATCCTGGGGAAAG
TGAGGGAAATATGGACATCACATGGAACAACATCCAGGAGACTCAGGCCTCTAGGAGTAACTGGGTAGTGTGCAT
CCTGGGGAAAGTGAGGGAAATATGGACATCACATGGAACAACATCCAGGAGACTCAGGCCTCTAGGAGTAACTGG
GTAGTGTGCATCCTGGGGAAAGTGAGGGAAATATGGACATCACATGGAACAACATCCAGGAGACTCAGGCCTCTA
GGAGTAACTGGGTAGTGCTTGGTTTAATCTTCTATTTACCTGCAGACCAGGAAGATGAGACCTCTCTGCCCTT
CTGACCTCGGGATTTTAGTTTTGTGGGGACCAGGGGAGATAGAAAAATACCCGGGGTCTCTTCATTATTGCTGCT
TCCTCTTCTATTAACCTGACCCTCCCCTCTGTTCTTCCCCAGAAAAGATAGATGTGGTACCCATTGAGCCTCATG
CTCTGTTCTTGGGAATCCATGGAGGGAAGATGTGCCTGTCCTGTGTCAAGTCTGGTGATGAGACCAGACTCCAGC
TGGAGGTAAAAACATGCTTTGGATCTCAAATCACCCCAAAACCCAGTGGCTTGAAACAACCAAAATTTTTCTTA
TGATTCTGTGGGTTGACCAGGATTAGCTGGGTAGTTCTGTTCCATGTGGTGGAACATGCTGGGGTCACTTTGGAA
GCTGCATTCAGCAGAGTGCCAGGCTTGCGCTGGGCATCCAAGGTGGTCCCTCATCCTCCAGGCTCTCTTTCCATG
TGATCTCTCAGTGTTTAAGAGTTAGTTGGAGCTTCCTTACAGCATGGCGGCTGACTTCCAAAAGGGATTATTCCA
AAAAGAGCCTCAACATGCAGGCGCTTATTATGACTTCTGCTTGCATCATCCTATTGGCCAAAGCCAGTCACGTGG
CTAAGTCTAGCCCCCTGTGAGAGGAGACTGCATAAGAGTGTGAACACCAGGAGACACGGTCACTGGGGGCCACCA
CTGTAACCATCTACCACAGGACCTGAATCTCTGTGTGCTACTCCCTTGCTCAAGGGCCCCCCTACCCACGCAGAC
CTGCTGTCTTCTAGCAAAGCCCATCCTCAGGACCTTTCTCTTCCAATCCTTATTGACTCAAATTGATTAGTTGGT
GCTCCACCCAGAGCCCTGTGCTCCTTTATCTCATGTAATGTTAATGGGTTTCCCAGCCCTGGGAAAACATGGCTT
TGTCTCAGGGGCTTGCTGGATGCAACCTTAACCTCAATGTGAGTGGCCATACTGTGGCACTGTCCCATCCCTCAC
CAGGGACACTGTTCTGGAGGGTGACTGCCTGTTCTGTGAGGAGTGGGGATGGCTAGGACATTGCATGGAACACAC
CACCACCCCATCTTCTCAGAGCTCAAACCCTGACAGAACACCAGCTCCACAGGCCTTGGCTTCTGCTGATGGTGC
CGTGTATTTACCAGACTTAGTGGTCCAAGGCCAGAGTGGCAGATTTCCCAAAGTCAAGGTGTGACAGTGGGACAG
CCTCTTTGTGTCTTTGCTGTCCTAAGAAACCTGGGCCAGGCCAGGCGCAGTGGCTCACGCCTTGTAATCCCAGCA
CTTTGAGAGGCCAAGGTGGGCAGATCACGAGGTCAGGAGTTTGAGACCAGCCTGGCCAACATTGGTGAAACCCTG
TCTCTATTAAAAATAGAAAACATTAGACAGGTGTGGTGGTGCATGCCTGTAATCCCAGCTACTCAGGAGGCTGAG
GCAGGAGAATCGCTTGAACCCAGGAGGTGGAGGTTGCAGTGAGCCGAGATTGTGCCACTGCACTCCAGCCTAGGC
```

FIGURE 93D

```
GACAGAGCAAGACTCCGTCTCGGGAAAATTAATTAATAAATAAATAAACCTAGGTCCCAGAGTCCCACAGAATGG
CAGACAGGAGCACCTGGGGGCTTTTAGGGTATGGCATTTCCCCTGTACTAACTCTGGGCTGTCCAGAGGCGATTT
CATGGCGTGGAGTGGAGAGGGAGGCAGCACAGGACTTCCTAGGCCTCAGCTCTCACCTGCCCATCTTTTGATTTC
CAGGCAGTTAACATCACTGACCTGAGCGAGAACAGAAAGCAGGACAAGCGCTTCGCCTTCATCCGCTCAGACAGT
GGCCCCACCACCAGTTTTGAGTCTGCCGCCTGCCCCGGTTGGTTCCTCTGCACAGCGATGGAAGCTGACCAGCCC
GTCAGCCTCACCAATATGCCTGACGAAGGCGTCATGGTCACCAAATTCTACTTCCAGGAGGACGAGTAGTACTGC
CCAGGCCTGCCTGTTCCCATTCTTGCATGGCAAGGACTGCAGGGACTGCCAGTCCCCCTGCCCCAGGGCTCCCGG
CTATGGGGCACTGAGGACCAGCCATTGAGGGGTGGACCCTCAGAAGGCGTCACAACAACCTGGTCACAGGACTC
TGCCTCCTCTTCAACTGACCAGCCTCCATGCTGCCTCCAGAATGGTCTTTCTAATGTGTGAATCAGAGCACAGCA
GCCCCTGCACAAAGCCCTTCCATGTCGCCTCTGCATTCAGGATCAAACCCCGACCACCTGCCCAACCTGCTCTCC
TCTTGCCACTGCCTCTTCCTCCCTCATTCCACCTTCCCATGCCCTGGATCCATCAGGCCACTTGATGACCCCCAA
CCAAGTGGCTCCCACACCCTGTTTTACAAAAAAGAAAAGACCAGTCCATGAGGGAGGTTTTTAAGGGTTTGTGGA
AAATGAAAATTAGGATTTCATGATTTTTTTTTTCAGTCCCCGTGAAGGAGAGCCCTTCATTTGGAGATTATGTT
CTTTCGGGGAGAGGCTGAGGACTTAAAATATTCCTGCATTTGTGAAATGATGGTGAAAGTAAGTGGTAGCTTTTC
CCTTCTTTTTCTTCTTTTTTGTGATGTCCCAACTTGTAAAAATTAAAAGTTATGGTACTATGTTAGCCCCATAA
TTTTTTTTTCCTTTTAAAACACTTCCATAATCTGGACTCCTCTGTCCAGGCACTGCTGCCCAGCCTCCAAGCTC
CATCTCCACTCCAGATTTTTACAGCTGCCTGCAGTACTTTACCTCCTATCAGAAGTTTCTCAGCTCCCAAGGCT
CTGAGCAAATGTGGCTCCTGGGGGTTCTTTCTTCCTCTGCTGAAGGAATAAATTGCTCCTTGACATTGTAGAGCT
TCTGGCACTTGGAGACTTGTATGAAAGATGGCTGTGCCTCTGCCTGTCTCCCCACCAGGCTGGGAGCTCTGCAGA
GCAGGAAACATGACTCGTATATGTCTCAGGTCCCTGCAGGGCCAAGCACCTAGCCTCGCTCTTGGCAGGTACTCA
GCGAATGAATGCTGTATATGTTGGGTGCAAAGTTCCCTACTTCCTGTGACTTCAGCTCTGTTTTACAATAAAATC
TTGAAAATGCCTATATTGTTGACTATGTCCTTGGCCTTGACAGGCTTTGGGTATAGAGTGCTGAGGAAACTGAAA
GACCAATGTGTYTTYCTTACCCCAGAGGCTGGCGCCTGGCCTCTTCTCTGAGAGTTCTTTTCTTCCTTCAGCCTC
ACTCTCCCTGGATAACATGAGAGCAAATCTCTCTGCGGGG
```

FIGURE 94

```
GGTGGAGGACGCGGCTGCTTCAAGTCCTTGGCTCTGATCCAGGCCACAGATTCCAGGATTCTACAGGCAGGAAAC
ATCTTAGAAATCAGGGTTGGGCAGGCAGGAGCCAGGAGAGTAGCTACAATGACTTCACCAGTACTGGTGGACATA
CGAGAAGAGGTGACCTGCCCTATCTGCCTGGAGCTCCTAACAGAACCCCTGAGCATAGACTGTGGCCACAGCTTC
TGCCAAGCCTGCATCACACCAAATGGCAGGGAATCAGTGATTGGTCAAGAAGGGGAAAGAAGCTGCCCTGTGTGC
CAGACCAGCTACCAGCCAGGGAACCTGCGGCCTAATCGGCATCTGGCCAACATAGTGAGGCGGCTCAGAGAGGTA
GTGTTGGGCCCTGGGAAGCAGCTGAAAGCAGTTCTTTGTGCAGACCATGGAGAAAAACTGCAGCTCTTCTGTCAG
GAGGATGGGAAGGTCATTTGCTGGCTTTGTGAGCGGTCTCAGGAGCACCGTGGTCACCACACGTTCCTCGTGGAG
GAGGTTGCCCAGGAGTACCAGGAGAAGTTTCAGGAGTCTCTAAAGAAGCTGAAGAACGAGGAGCAGGAAGCTGAG
AAGCTAACAGCTTTTATCAGAGAGAAGAAGACATCCTGGAAGAATCAGATGGAGCCTGAGAGATGCAGGATCCAG
ACAGAGTTTAATCAGCTGCGAAATATCCTAGACAGAGTGGAGCAACGGGAGCTGAAAAAGCTGGAACAGGAAGAG
AAGAAGGGGCTACGAATTATAGAAGAGGCTGAGAATGATCTGGTCCACCAGACCCAGTCGCTGCGAGAGCTCATC
TCGGATCTGGAGCGTCGATGTCAGGGGTCAACAATGGAGCTGCTGCAGGATGTGAGTGATGTCACAGAAAGGAGT
GAGTTCTGGACCCTGAGGAAGCCAGAAGCTCTCCCTACAAAGCTGAGAAGTATGTTCCGAGCCCCAGATCTGAAA
AGGATGCTGCGAGTGTGTAGAGAGCTGACAGATGTCCAAAGCTACTGGGTTGACGTGACCCTGAATCCACACACA
GCTAATTTAAATCTTGTCCTGGCTAAAAACCGGAGACAAGTGAGGTTTGTGGGAGCTAAAGTATCTGGACCTTCC
TGTCTGGAAAAGCATTATGACTGTAGTGTCCTGGGCTCCCAGCACTTCTCCTCTGGTAAGCATTACTGGGAGGTA
GATGTGGCCAAGAAGACTGCCTGGATCCTAGGGGTATGCAGCAATTCACTGGGACCTACATTCTCTTTCAACCAT
TTTGCTCAAAATCACAGTGCTTACTCCAGGTATCAGCCTCAGAGTGGATACTGGGTGATTGGGTTACAGCATAAC
CATGAATATAGGGCCTATGAGGATTCTTCCCCTTCCCTGCTTCTCTCCATGACAGTGCCCCCTCGCCGTGTTGGG
GTTTTCTTAGATTATGAGGCTGGTACTGTCTCCTTTTATAATGTCACAAACCATGGCTTCCCCATCTACACTTTC
TCTAAATATTACTTTCCCACTACTCTTTGTCCATATTTTAATCCTTGCAACTGTGTAATTCCTATGACCCTGCGT
CGTCCAAGCTCTTGAATATTCTTCTGTTCCCACCCACTTCTGATAAGTACCCTGAGGCTTATCAGCATGTGATTC
TCCCTTCTGATCTTCTGTTTTTCTGTGTTCTCAATTCTTTTGTTGTTTTTGGTTTTTGAATCTTTTTTGAGATG
GAATCTCGCTCTGTCGCCCAGGCTGGAGTGCACTGGCGCAATCTCGGCTCACTGCAACCTCTGCCTCCTGGGTTC
AAGCGAACCTCCTGCCTCAGCATCCCAAGTAGCTGGGATTACAGGCACCCACCACCATGCCCAACTAATTTTTGT
ATTTTTATAGAGATAGGGTTTCACCGTGTTGGCCAGGCTGATCTCGAACTCCTGACCGCAAGTGATCCACCCGCC
TCGGTCTCCCAAAGTGCTGGGATTACAGATGTGAGCCGCCGCGCCCAGACAGTTCTTTCGTTTTAAACAGTTACT
CAGTACTAGGATGCACCCAGTGGTGAGAGTAAGCATCTTTGACTGATGACAGGTCTTGAGGTGGATAGGGGCGC
TTTCAGTATTTTGCCATTAAGCATAGTATTTGATGCAGGTTTTTTTTGATTGATGCAGGGGATCAAATTTAGGAA
GTTCTGATCTGTTAATTTACTACAAGTTTTTGTATAAAATGAAAACTCGTATTCTACCTATGTCTTTTCTGTAAA
TTATTGAGACAATTGTGTATCATTTTTGTTCTGTTAATGTGGCTTAGTACATTGATTTACTTCAATTTGTTACCA
CAACTTGCTGAAATACACCATTATTATTTGTTGTATGCAATACTGGATTTATTTTGATAACGTATTGTTTAGATT
TTGTTCTCATCTATGTTAATGAAAGAAATTGGCCTGTATTTTACATTCTTGTAATATCTTTGCCAGGTTCTATA
AAATGCAATAATAAGCAAATAAATTACTTTGTTTTTGTATAAGTATGTATAGGATTGAGCTCTAAAACCAAACCA
TTATAATGATAATTTGGGTAGCTTCAAACTCAAATTGAAGAGAGTCTTCACTACAATCTTCACTACAACCTTTGG
CCTTCCTCTCTACATTTAAGAGTAGCAATAGAACAATAAAAAAAATACGTCTTTCAAATTAATTGCAGTAAAAA
CAAAAGAGTAGTGGGGAGAGAAAAACAATCCAATACATATTTTCTCTCAGAATAGAAAGAAAACACAAAGAGAA
AATATGAACAATATAAAGCACTTAAAGGAAGAGGATGATTTCTTCCAGCTTTTCCACACTCTCTTTATGCGCAGG
AACAAACAGCTGTTGAGTGAGCTGCTATGACTTTGGTAGAGAGGTGCAATATGTTTTTGAACCAGCTATAAAAG
AAATTAAGAGGTACATGTGAGGGTAGAAACAAATATCAAGGATGAGAATGGCACTGGCTGTCCCATATGGTATCC
AGGAGCCACCAATGTCTGTTGAGTACTTCATACATGCCTAGTCTGAATTGAGATGTGCTCAATGTATAAAATATA
TACCAGATTTCAAATACCTACTTCAAAAAATAATGTAAAATATCTCACTAATAACTTTTCCTTTGTGTATTGCAA
TGATAATATGTTGGCTCTATTGGATTAAATAAAGTATGTTATTCATTTTAAAAAAAAAAAAAAAAAAAAAAAAA
AAAAA
```

FIGURE 95

MTSPVLVDIREEVTCPICLELLTEPLSIDCGHSFCQACITPNGRESVIGQEGERSCPVCQTSYQPGNLRPNRHLA
NIVRRLREVVLGPGKQLKAVLCADHGEKLQLFCQEDGKVICWLCERSQEHRGHHTFLVEEVAQEYQEKFQESLKK
LKNEEQEAEKLTAFIREKKTSWKNQMEPERCRIQTEFNQLRNILDRVEQRELKKLEQEEKKGLRIIEEAENDLVH
QTQSLRELISDLERRCQGSTMELLQDVSDVTERSEFWTLRKPEALPTKLRSMFRAPDLKRMLRVCRELTDVQSYW
VDVTLNPHTANLNLVLAKNRRQVRFVGAKVSGPSCLEKHYDCSVLGSQHFSSGKHYWEVDVAKKTAWILGVCSNS
LGPTFSFNHFAQNHSAYSRYQPQSGYWVIGLQHNHEYRAYEDSSPSLLLSMTVPPRRVGVFLDYEAGTVSFYNVT
NHGFPIYTFSKYYFPTTLCPYFNPCNCVIPMTLRRPSS

FIGURE 96

ACTCACAGGACAACCACCACAGGCACCACCACACTCCTTGTACCCCTTGCCCTTCTCCCAGCTCATTGCTCCAGG
AGAGAGAAGAGTTCAAAAAATAAAGTAATCATAAACTTGAACTCTCTCCATTCTCTTGTTCCCATTTACAGGTGA

ATCTCTTCCTTTAAGCCATTTTTGTCTCCTGTGAATACAGCCTTATCTCCACCTGTTTCTTAGATCCCATCTCCC
CTGGCTTATTTTTTCCATTCATTACCCTCTTTGTTCCCTTTACTTCTCAACCTGTGCTATATACATGCTGTTCTC
TCTGTTGAGATTGCCTTATTTCCATCTAACATTCTCTCTCCTGCTATTCTGATTTGTCATTCACAACTGATTTCA
AGAGTCACCTTCACCAGGAAGTCTTCCTTGACCACCATCATTCCTGCCTGATTAGAGGGCTTCCTCATGGTAATA
TGTGTTCTCAAGTTTTCAGTGTCAAGGAATGCCATCCCAGAAGCTCATTCTCAGATGCACAACAGCCAGAACAGT
CTCAAGCAGCATTCTAGAGCTTGGAATTTAAGAACTACGCATTGCCTATAAAGTGAAACATAGGCTAATATAGAT
TAAATTGAATATTGAATAAAAAATATATTTATTTATCC

FIGURE 97

THRTTTTGTTTLLVPLALLPAHCSRREKSSKNKVIINLNSLHSLVPIYR

FIGURE 98

ACCCAGGGTCCGGCCTGCGCCTTCCCGCCAGGCCTGGACACTGGTTCAACACCTGTGACTTCATGTGTGCGCGCC
GGCCACACCTGCAGTCACACCTGTAGCCCCCTCTGCCAAGAGATCCATACCGAGGCAGCGTCGGTGGCTACAAGC
CCTCAGTCCACACCTGTGGACACCTGTGACACCTGGCCACACGACCTGTGGCCGCGGCCTGGCGTCTGCTGCGAC
AGGAGCCCTTACCTCCCCTGTTATAACACCTGACAGCCACCTAACTGCCCCTGCAGAAGGAGCAATGGCCTTGGC
TCCTGAGAGGTAAGAGCCCGGCCCACCCTCTCCAG<u>ATG</u>CCAGTCCCCGAGCGCCCTGCAGCCGGCCCTGACTCTC
CGCGGCCGGGCACCCGCAGGGCAGCCCCACGCGTGCTGTTCGGAGAGTGGCTCCTTGGAGAGATCAGCAGCGGCT
GCTATGAGGGGCTGCAGTGGCTGGACGAGGCCCGCACCTGTTTCCGCGTGCCCTGGAAGCACTTCGCGCGCAAGG
ACCTGAGCGAGGCCGACGCGCGCATCTTCAAGGCCTGGGCTGTGGCCCGCGGCAGGTGGCCGCCTAGCAGCAGGG
GAGGTGGCCCGCCCCCGAGGCTGAGACTGCGGAGCGCGCCGGCTGGAAAACCAACTTCCGCTGCGCACTGCGCA
GCACGCGTCGCTTCGTGATGCTGCGAGATAACTCGGGGACCCGGCCGACCCGCACAAGGTGTACGCGCTCAGCC
GGGAGCTGTGCTGGCGAGAAGGCCCAGGCACGGACCAGACTGAGGCAGAGGCCCCCGCAGCTGTCCCACCACCAC
AGGGTGGGCCCCAGGGCCATTCCTGGCACACACACATGCTGGACTCCAAGCCCCAGGCCCCCTCCCTGCCCCAG
CTGGTGACGAGGGGGACCTCCTGCTCCAGGCAGTGCAACAGAGCTGCCTGGCAGACCATCTGCTGACAGCGTCAT
GGGGGGCAGATCCAGTCCCAACCAAGGCTCCTGGAGAGGGACAAGAAGGGCTTCCCCTGACTGGGGCCTGTGCTG
GAGGCCCAGGGCTCCCTGCTGGGGAGCTGTACGGGTGGGCAGTAGAGACGACCCCCAGCCCCGGGCCCCAGCCCG
CGGCACTAACGACAGGCGAGGCCGCGGCCCCAGAGTCCCCGCACCAGGCAGAGCCGTACCTGTCACCCTCCCCAA
GCGCCTGCACCGCGGTGCAAGAGCCCAGCCCAGGGGCGCTGGACGTGACCATCATGTACAAGGGCCGCACGGTGC
TGCAGAAGGTGGTGGGACACCCGAGCTGCACGTTCCTATACGGCCCCCCAGACCCAGCTGTCCGGGCCACAGACC
CCCAGCAGGTAGCATTCCCCAGCCCTGCCGAGCTCCCGGACCAGAAGCAGCTGCGCTACACGGAGGAACTGCTGC
GGCACGTGGCCCCTGGGTTGCACCTGGAGCTTCGGGGGCCACAGCTGTGGGCCGGCGCATGGGCAAGTGCAAGG
TGTACTGGGAGGTGGGCGGCCCCCCAGGCTCCGCCAGCCCCTCCACCCCAGCCTGCCTGCTGCCTCGGAACTGTG
ACACCCCATCTTCGACTTCAGAGTCTTCTTCCGAGAGCTGGTGGAATTCCGGGCACGGCAGCGCCGTGGCTCCC
CACGCTATACCATCTACCTGGGCTTCGGGCAGGACCTGTCAGCTGGGAGGCCCAAGGAGAAGAGCCTGGTCCTGG
TGAAGCTGGAACCCTGGCTGTGCCGAGTGCACCTAGAGGGCACGCAGCGTGAGGGTGTGTCTTCCCTGGATAGCA
GCAGCCTCAGCCTCTGCCTGTCCAGCGCCAACAGCCTCTATGACGACATCGAGTGCTTCCTTATGGAGCTGGAGC
AGCCCGCC<u>TAG</u>AACCCAGTCTAATGAGAACTCCAGAAAGCTGGAGCAGCCCACCTAGAGCTGGCC

FIGURE 99

MPVPERPAAGPDSPRPGTRRAAPRVLFGEWLLGEISSGCYEGLQWLDEARTCFRVPWKHFARKDLSEADARIFKA
WAVARGRWPPSSRGGGPPPEAETAERAGWKTNFRCALRSTRRFVMLRDNSGDPADPHKVYALSRELCWREGPGTD
QTEAEAPAAVPPPQGGPPGPFLAHTHAGLQAPGPLPAPAGDEGDLLLQAVQQSCLADHLLTASWGADPVPTKAPG
EGQEGLPLTGACAGGPGLPAGELYGWAVETTPSPGPQPAALTTGEAAAPESPHQAEPYLSPSPSACTAVQEPSPG
ALDVTIMYKGRTVLQKVVGHPSCTFLYGPPDPAVRATDPQQVAFPSPAELPDQKQLRYTEELLRHVAPGLHLELR
GPQLWARRMGKCKVYWEVGGPPGSASPSTPACLLPRNCDTPIFDFRVFFRELVEFRARQRRGSPRYTIYLGFGQD
LSAGRPKEKSLVLVKLEPWLCRVHLEGTQREGVSSLDSSSLSLCLSSANSLYDDIECFLMELEQPA

FIGURE 100A

```
AGGTGCGAGTCCCCACTGCTGGGGAGGCGGCGGGCCCCGGCTCCCCTCGGCCGCCTAGCCCGCCTCGCCCGCCCG
GGGTTGGCGGGGAGGGAACAGCTGGGCGGCCCCAGAGCCCCTCGGAGGACAATGCGCCCGGCGCTCGGCCACCCT
CGCTCGGTCTCCTCCGCGTCCGGTTCCTTCCCGCCGCCCCGGCAGCCGCCCGGCTGCAGCCCCTCTTCCTCCGC
GGGGGCTCCTTCCGCGGCCGGAGAGGCTCCGGCGACAGCAGCACCAGCACCAGCACCAGCCGCGGGGGAGGCGGC
GGCAGACGCGGCGGGGGCGGCGGCTCCCCGAGCAGCAGCACGGGCGCCGAGCGCGAGGACGACGACGAGAGCCTC
AGCGTCAGCAAGCCGCTGGTGCCCAACGCCGCGCTCCTGGGGCCGCCGGCTCAGGTGGGCGCCCCGCCGGCCCC
GCGCCTGTCGCCTTCTCCTCCTCAGCGGCCACCTCCTCCTCCACCTCCACGCCCACCTCCTCCTGCAGCATGACA
GCCGCGGACTTCGGCGGGGGCGCCGCGGCCGGGGCCGTCGGGGGCCCCGGGAGCCGCTCGGCGGGGGGCGCGGGC
GGCACCGGGACCGGCAGCGGCGCCTCCTGCTGCCCGTGTTGCTGCTGCTGCGGCTGCCCAGACCGCCCCGGCCGC
AGAGGTCGGCGCCGCGGCTGCGCCCCCAGTCCCAGGTGCCGCTGGGGCTACCAGGCGCTGTCCGTGGTGCTGCTG
CTGGCGCAGGGCGGCCTGCTGGACCTGTACCTCATCGCCGTCACCGACCTGTACTGGTGCTCCTGGATCGCCACT
GACCTGGTGGTGGTGGTGGGCTGGGCCATCTTCTTCGCCAAGAACAGCCGGGGCCGTCGGGGCGGCGCAGCCAGC
GGCGCGCACAACCACCACCTGCACCACCACCACGCCGCGCCGCCCCTGCATCTGCCCGCCCCTCGGCCGCTACC
GCTGGGGCCAAGGCACGCGGAGCCCGCGGGGGCGCCGGCGGCGCGGGGGGCGGCCTGGGGGCGGCCGCGGCAGCG
GGCGAGTTCGCCTTCGCCTACCTGGCCTGGCTTATCTACTCCATCGCCTTCACTCCCAAGGTGGTGCTGATCCTG
GGCACGTCCATCCTAGACCTCATCGAGCTACGCGCGCCCTTCGGCACCACGGGCTTCCGTCTCACCATGGCGCTG
TCGGTGCCCCTGCTCTACAGCTTGGTGCGGGCCATCAGCGAGGCGGGCGCGCCCCCGGGATCGGCAGGACCCCTG
CTGCTGCAGCCCCAGCGGCACCGCGCGGCCGGATGCTTCCTGGGCACGTGCTTGGACCTGCTCGACAGCTTCACG
CTGGTGGAGCTGATGCTGGAGGGCCGCGTGCCGCTGCCCGCGCACCTGCGCTACCTGCTTATCGCCGTCTACTTC
CTCACCCTCGCCTCGCCGGTGCTCTGGCTCTACGAGCTCAACGCCGCGGCCGCAGCGGCTGCATCCTGGGGCCAG
GCCTCCGGGCCTGGCAGCTGCAGCCGCCTTCTGCGCCTGCTGGGCGGCTGCCTGGTGGACGTGCCCTTGCTGGCG
CTGCGCTGCCTCCTGGTGGTCAGCTACCAGCAGCCCCTCTCCATCTTCATGCTCAAGAACCTCTTCTTCCTCGGC
TGCCGGGGCCTGGAGGCCCTGGAGGGCTGCTGGGACCGGGGCAATCGGGCCTCCCCGAGTCGGGCCAGAGGGGGC
TACGGTGCTCCGCCCTCCGCCCCTCCACCACCTCCGCCACCACCTCAGGGAGGCTCCCAGCTGGGCCACTGCATC
TCGGAGAACGAGGGGGGTGCTCATGGCTATGTCAACACCCTGGCTGTGGCCTCTCAGAATTGAGGGTGAAGGGCA
CGGGTCCTTGTTTTTGGGTTGAGAGTCCCCAACCCCCTTGTCTTCTACCTTCTGTCACCTAGATTTGATCAGGGT
CTATTTGGAAGAGGTAACCCTTTTCAGGGCTAAGGGCCAGGGTGTCCTTCTGCACCCTGGGGTGAGGACGGCTTG
GAGGGAGACCAGCAGTTAACGGTGAGGGAGGTAGGTGCACTTACCCTCTCCTCTCTTCTCCTATCCTACCCCAAT
CCTGACCTCCAAGGGGCTGGTACCTCTGCTTCTTGCTTTGCCCACCTCCACTCTAATTCCCATCCATTAGGAGGA
GAGGGGTGCTGGGCCTTGGACCTTCTCCCTTGCTTAGAAGTGCCAGCCTCTTTTAGGCTGTGGTTAGTGGCCATT
GTCCCATGCCTTGAAATTGACCCAGAACCCACTTTCCACTGATGTGTCTCTTGGATTTCTTCCAGGTGATAGATA
CAAAGTGTATGTCTCTGTGTGTGTAGTGTTGTTTTCTCGTGTCCACCCTGTGGCCCTTTGCAATGGGTAGGAGAT
CTGGGGAGGCCCTGCCCCCTACACCATACTTATCACCACCCTCCTCTTTTCTGCCTGGATTTGTGACCATGAATT
CCCAGGAAGAGCTGGGCCCCTGGGAGCTGCCCAGGTACTCCCCTTGAAGGGAGAATCTCACCCAGGATCTTCCTC
AATACTGCTCCTCTCTTCTCAGCTCAGGGAGAGGAGGGGATCCATTCTCTAAGGACCAAACTGCACCCTTTCTTG
GGTGAGTGAGCATTTCTACCTCCGTGCTTTCAACTTTTGTTGCATCATGCACTGATGCTGCTTGCAAAAAATGAA
GACAAAATACTCAGAAGTTGCATTTGCCATGGCCACTGGCTCCAGCTGGGGTTTGGTGCCAGTGTTATTACAGGG
TCTGCGGAGTATCAGCCATTGGCTTGGCCTCTCTCTGTTCCTCCCTCTGCACCTAGAACTCTTATCCTTCCTGTG
GTTTGGTGCCGACTGGGTCGGATCTGGGCTTAGAGTAATAGCTTTGGTGGGTTTCCTGGATGGATGTGAAGTTGG
GCCTCCCATGGGCCCAAGGGAGTAGGAAGCCCCATTCCCCACCTGTCCTTCCTCTAGGAAGTGTAGATCAGAAAG
TGAGGTGGTGACCTCCCACCTCTGGTCTGGTTAAGAGTCTCACTAGGGCCAAGGCAGGCTGCAGAACTTTCCCTC
TTCCTCTCATTGAGGGTGATGACAAGAGACATCCGGGGACTGTGCACTTACAGTCGGTGTGGAATGTCACTCTTG
CAGTCTTTGAGGCAGGATAAGTATTTTTACATATTTTAAGGGTGCAGGAGGACAGCAGCTAACAAGGCCAGGAAA
TACTCACTTCCCTCCACCCTCAACAGGATGTGGTGGGGGTGAAACTTGAAGAATTTTTGTTTCCCCTTCTCCCTT
CTTACGTTTGGGAAGTTTTATGTAGTGTAACAAACTCTAGACGAGTTACCAGAAGATGTGGATTCTAGTTCTGAT
TCTGTCACTCATTGGCTTTGAGTGACATATTTTTATTTCCTGGGCCTGTTTTCTCACATTAAAAAAGTAGAAGTT
AGATGAGTGATCTCTAAGGTTGAAGGTAATTTCAGCTCTCACATTCTTTTGAGTTTGTGGCTCTTGAAAGCCCTG
GTCCTGATGCTCCCTGTAAAGGTGGCTGGGAGAGAAGCCAGCCAGGCTGCACTTGCAGAACATTCCCTGCTCTGT
```

FIGURE 100B

```
ACTGGGTGTGTGAAGCCCCAGCAGAGAAGGCCGGAGGGAGGGCTTGGGTGCCTGGGCTGGGTGTGGGGCAGGGCC
TGGCACAGCTGCAGAGTGCACAGGGAGGGTCAGAAGTGCCAAGTCACTGGCCGTTAACTCAGCACCCAGGCCAAG
CCCCCGCCTCCCACTTGAAGCCCCTCTTACAACTGTTTTGGGGGCTTGGAGCAGAAGACACCCTTGTAGACAGA
CATAAGAGGGGCAGAAGGCTTGACCAGAGTTCTCTTGAGCCTCCTCATGCTCTCAGAGCAGGGAACAGCGGGGGG
AAAATGTTTACACTCCATGCACAATCTGTGCTTCCAGTCCCTCACCCTATGTGGCCCAATAGCTGGCTGGATTTC
ACACTTAATTGGTATTTTTTCTGCCTTCTTCCCCTGCCCCCACTGACTCCTCCTCTCCCTTTGATTGTACTC
AAGGTTCTGGGGCCTGGGCCCTGGGTGGGTACCAACAGCTGCTCGCTGTTCCCATGTCCTCTCTCCAGCTTTGCT
GTGTTTCTCTGCTACCTAATCTCAGTGACTGTGAAAGGACATTGTGTCTGAGCCATGCCCAGCCGCTGGCTGGCC
CCCTGATCTGCCCCCCTTCTATTGTTTGGATGGCCATCTCCTGCTGGGCCTCCCTGACTGTAAAATCTCTGTACT
GTTTGTTAGGTTTTTGGTGGGAGGCTGTGATAAGTTCCAATGAGCTGCCACTTCCCTGGATATGTCAAGAAGCTG
ATGGCAACTTGGCCAATTCTGGCAGATATCAGGCCCCCAGTTCAGCCCCAGTCACCCTCTTTTACACATGTGGGT
CAACCACTGTGTGCTCAGAGGGTCAGTCCCTTCCTCTGCTGTGTTTTCTTGAGTCCTTGCACTCACTTCCCCTG
CCCCAGTCACGATGACCCCTAAAGCTTCCTTTGCCCTTGCTTTCTAGGGCATCCCTAGTGAAGGGGCAAACCTGA
GATTCTCCGTGGACCTGACAGCCAAGGCAGGGCACTGTCTCCTGAGGCCAGTGCCAGCACGTGCATGGTTCACA
GAAAAGGATCCTGGGCTCAGAATCTCGAGAACCGCCTGCTCCTAACAATTCAGCAAGTCAGGGGCTTCCTCTCTG
TTAGTCCCCAAATCCTTACTTATTTTAAAAAGACTAGACCCTCTCTAAAGACTGTTCCATTTTAACATGTCCTGA
TTCTGCATCCGTGGGTTTTGTGAAAGAGAGCTAGCTGGCGGTTAGAGCCTGGAAGAAGGAGGGAAGTGGCACCTC
ACTAGCATTTATCACTTTTTCCTTCTCTTTTAAAAATAAAACCAGACTCTGTTCTGAAAATAAAAAACTTGAG
ACTTGAAAAAAAAAAAAAAAAAA
```

FIGURE 101

```
MRPALGHPRSVSSASGSFPPPPAAARLQPLFLRGGSFRGRRGSGDSSTSTSTSRGGGGGRRGGGGGSPSSSTGAE
REDDDESLSVSKPLVPNAALLGPPAQVGAPAGPAPVAFSSSAATSSSTSTPTSSCSMTAADFGGGAAAGAVGGPG
SRSAGGAGGTGTGSGASCCPCCCCCGCPDRPGRRGRRRGCAPSPRCRWGYQALSVVLLLAQGGLLDLYLIAVTDL
YWCSWIATDLVVVVGWAIFFAKNSRGRRGGAASGAHNHHLHHHHAAPPLHLPAPSAATAGAKARGARGGAGGAGG
GLGAAAAAGEFAFAYLAWLIYSIAFTPKVVLILGTSILDLIELRAPFGTTGFRLTMALSVPLLYSLVRAISEAGA
PPGSAGPLLLQPQRHRAAGCFLGTCLDLLDSFTLVELMLEGRVPLPAHLRYLLIAVYFLTLASPVLWLYELNAAA
AAAASWGQASGPGSCSRLLRLLGGCLVDVPLLALRCLLVVSYQQPLSIFMLKNLFFLGCRGLEALEGCWDRGNRA
SPSRARGGYGAPPSAPPPPPPPPQGGSQLGHCISENEGGAHGYVNTLAVASQN
```

FIGURE 102

```
ACAGAGATGGCACTGATGCAGGAACTGTATAGCACACCAGCCTCCAGGCTGGACTCCTTCGTGGCTCAGTGGCTG
CAGCCCCACCGGGAGTGGAAGGAAGAGGTGCTAGACGCTGTGCGGACCGTGGAGGAGTTTCTGAGGCAGGAGCAT
TTCCAGGGGAAGCGTGGGCTGGACCAGGATGTGCGGGTGCTGAAGGTAGTCAAGGTGGGCTCCTTCGGGAATGGC
ACGGTTCTCAGGAGCACCAGAGAGGTGGAGCTGGTGGCGTTTCTGAGCTGTTTCCACAGCTTCCAGGAGGCAGCC
AAGCATCACAAAGATGTTCTGAGGCTGATATGGAAAACCATGTGGCAAAGCCAGGACCTGCTGGACCTCGGGCTC
GAGGACCTGAGGATGGAGCAGAGAGTCCCCGATGCTCTTGTCTTCACCATCCAGACCAGGGGGACTGCGGAGCCC
ATCACGGTCACCATTGTGCCTGCCTACAGAGCCCTGGGGCCTTCTCTTCCCAACTCCCAGCCACCCCCTGAGGTC
TATGTGAGCCTGATCAAGGCCTGCGGTGGTCCTGGAAATTTCTGCCCATCCTTCAGCGAGCTGCAGAGAAATTTC
GTGAAACATCGGCCAACTAAGCTGAAGAGCCTCCTGCGCCTGGTGAAACACTGGTACCAGCAGTATGTGAAAGCC
AGGTCCCCCAGAGCCAATCTGCCCCCTCTCTATGCTCTTGAACTTCTAACCATCTATGCCTGGGAAATGGGTACT
GAAGAAGACGAGAATTTCATGTTGGACGAAGGCTTCACCACTGTGATGGACCTGCTCCTGGAGTATGAAGTCATC
TGTATCTACTGGACCAAGTACTACACACTCCACAATGCAATCATTGAGGATTGTGTCAGAAAACAGCTCAAAAAA
GAGAGGCCCATCATCCTGGATCCGGCCGACCCCACCCTCAACGTGGCAGAAGGGTACAGATGGGACATCGTTGCT
CAGAGGGCCTCCCAGTGCCTGAAACAGGACTGTTGCTATGACAACAGGGAGAACCCCATCTCCAGCTGGAACGTG
AAGAGGGCACGAGACATCCACTTGACAGTGGAGCAGAGGGGTTACCCAGATTTCAACCTCATCGTGAACCCTTAT
GAGCCCATAAGGAAGGTTAAAGAGAAAATCCGGAGGACCAGGGGCTACTCTGGCCTGCAGCGTCTGTCCTTCCAG
GTTCCTGGCAGTGAGAGGCAGCTTCTCAGCAGCAGGTGCTCCTTAGCCAAATATGGGATCTTCTCCCACACTCAC
ATCTATCTGCTGGAGACCATCCCCTCCGAGATCCAGGTCTTCGTGAAGAATCCTGATGGTGGGAGCTACGCCTAT
GCCATCAACCCCAACAGCTTCATCCTGGGTCTGAAGCAGCAGATTGAAGACCAGCAGGGGCTTCCTAAAAAGCAG
CAGCAGCTGGAATTCCAAGGCCAAGTCCTGCAGGACTGGTTGGGTCTGGGGATCTATGGCATCCAAGACAGTGAC
ACTCTCATCCTCTCGAAGAAGAAAGGAGAGGCTCTGTTTCCAGCCAGTTAGTTTTCTCTGGGAGACTTCTCTGTA
CATTTCTGCCATGTACTCCAGAACTCATCCTGTCAATCACTCTGTCCCATTGTCTACTGGGAAGGTCCCAGGTCT
TCACCAGTTTTACAATGAGTTATCCCAGGCCAGACGTGGTAGCTCACACCTGTAATCCCAGAACTTTGGGAGGCC
GAGGTGGGAGGAGCGCTTGAGCCGAGGAGTTCAAGACCAGCCTGGGTATCATAGGGAGACCCCGTCTCTACAAAA
TAAAAAATAATTCACTGGG
```

FIGURE 103

MALMQELYSTPASRLDSFVAQWLQPHREWKEEVLDAVRTVEEFLRQEHFQGKRGLDQDVRVLKVVKVGSFGNGTV
LRSTREVELVAFLSCFHSFQEAAKHHKDVLRLIWKTMWQSQDLLDLGLEDLRMEQRVPDALVFTIQTRGTAEPIT
VTIVPAYRALGPSLPNSQPPPEVYVSLIKACGGPGNFCPSFSELQRNFVKHRPTKLKSLLRLVKHWYQQYVKARS
PRANLPPLYALELLTIYAWEMGTEEDENFMLDEGFTTVMDLLLEYEVICIYWTKYYTLHNAIIEDCVRKQLKKER
PIILDPADPTLNVAEGYRWDIVAQRASQCLKQDCCYDNRENPISSWNVKRARDIHLTVEQRGYPDFNLIVNPYEP
IRKVKEKIRRTRGYSGLQRLSFQVPGSERQLLSSRCSLAKYGIFSHTHIYLLETIPSEIQVFVKNPDGGSYAYAI
NPNSFILGLKQQIEDQQGLPKKQQQLEFQGQVLQDWLGLGIYGIQDSDTLILSKKKGEALFPAS

FIGURE 104

```
TTTCTTCCAAGGAACAAAGGCTTTTGGTGCCAAACTGAAGGAAATTGAAAAGCAGCACAAGAACTGTGAAAACTT
TTATTCCTTCATGATCATGAAAAGCAATTTTGATGAAACATATATAGAAAATGTAGTCAGGAATATCCTAAAAGG
ACAGGATGTTGACAGCAAGGAAGCACAACTCATTTCCTTCCTGGCTTTACTCAGCTCTTATGTTACTGACTCTAC
AATTTCAGTTTCACAGTGTGAAATATTTTTGGGAATCATATACACTAGTACACCCTGGGAACCTGAAAGCTTAGA
AGACAAGATGGGAACTTATTCTACACTTCTAATAAAAACAGAAGTTGCAGAATATGGGAGATACACAGGTGTGCG
TATCATTCACCCTCTGATTGCCCTGTACTGTCTAAAAGAACTGGAAAGAAGCTATCACTTGGATAAATGTCAAAT
TGCATTGAATATATTAGAAGAGAATTTATTCTATGATTCTGGAATAGGAAGAGACAAATTTCAACATGATGTTCA
AACTCTTCTGCTTACAAGACAGCGCAAGGTGTATGGAGATGAAACAGACACTCTGTTTTCCCCATTAATGGAAGC
TTTACAGAATAAAGACATTGAAAAGGTCTTGAGTGCAGGAAGTAGACGATTCCCACAAAATGCATTCATTTGTCA
AGCCTTAGCAAGACATTTCTACATTAAAGAGAAGGACTTTAACACAGCTCTGGACTGGGCACGTCAGGCCAAAAT
GAAAGCACCTAAAAATTCCTATATTTCAGATACACTAGGTCAAGTCTACAAAAGTGAAATCAAATGGTGGTTGGA
TGGGAACAAAAACTGTAGGAGCATTACTGTTAATGACCTAACACATCTCCTAGAAGCTGCGGAAAAAGCCTCAAG
AGCTTTCAAAGAATCCCAAAGGCAAACTGATAGTAAAAACTATGAAACCGAGAACTGGTCACCACAGAAGTCCCA
GAGACGATATGACATGTATAACACAGCTTGTTTCTTGGGTGAAATAGAAGTTGGTCTTTACACTATCCAGATTCT
TCAGCTCACTCCCTTTTTCCACAAAGAAAATGAATTATCCAAAAAACATATGGTGCAATTTTTATCAGGAAAGTG
GACCATTCCTCCTGATCCCAGAAATGAATGTTATTTGGCTCTTAGCAAGTTCACATCCCACCTAAAAAATTTACA
ATCAGATCTGAAAAGGTGCTTTGACTTTTTTATTGATTATATGGTTCTTCTGAAAATGAGGTATACCCAAAAAGA
AATTGCAGAAATCATGTTAAGCAAGAAAGTCAGTCGTTGTTTCAGGAAATACACAGAACTTTCTGTCATTTGGA
TCCATGTCTATTACAAAGTAAAGAGAGTCAATTACTCCAGGAGGAGAATTGCAGGAAAAAGCTAGAAGCTCTGAG
AGCAGATAGGTTTGCTGGACTCTTGGAATATCTTAATCCAAACTACAAAGATGCTACCACCATGGAAAGTATAGT
GAATGAATATGCCTTCCTACTGCAGCAAAACTCAAAAAAGCCCATGACAAATGAGAAACAAAATTCCATTTTGGC
CAACATTATTCTGAGTTGTCTAAAGCCCAACTCCAAGTTAATTCAACCACTTACCACGCTAAAAAAACAACTCCG
AGAGGTCTTGCAATTTGTAGGACTAAGTCATCAATATCCAGGTCCTTATTTCTTGGCCTGCCTCCTGTTCTGGCC
AGAAAATCAAGAGCTAGATCAAGATTCCAAACTAATAGAAAAGTATGTTTCATCCTTAAATAGATCCTTCAGGGG
ACAGTACAAGCGCATGTGCAGGTCCAAGCAGGCAAGCACACTTTTCTATCTGGGCAAAAGGAAGGGTCTAAACAG
TATTGTTCACAAGGCCAAAATAGAGCAGTACTTTGATAAAGCACAAAATACAAATTCCCTCTGGCACAGTGGGGA
TGTGTGGAAAAAAAATGAAGTCAAAGACCTCCTGCGTCGTCTAACTGGTCAGGCTGAAGGCAAGCTAATCTCTGT
AGAATATGGAACAGAGGAAAAAATAAAAATACCAGTAATATCTGTTTATTCAGGTCCACTCAGAAGTGGTAGGAA
CATAGAAAGAGTGTCTTCTACCTAGGATTTTCCATTGAAGGCCCTCTGGCATATGATATAGAAGTAATTTAAGA
CAATACATCACCTGTAGTTCAAATACGTTTATTTATATCTTTATGATTTTATTCTCTCTCTATTCTCATGGCA
CTTTCATAACATTATGGCTAACCTCTAATTACAGATTTTGCTTTTGCCTCCCTGAATGAATTACAAGCCTTTTA
AGATATGAAATATGCCTACCCGCAGAGCTTGGCACAAAGTGGAGTCAATCTTTTAATGTTTTAAATATGCATTTT
CAGACTCAAATAATTAAGAAGTTTCATTGATATCCACTGGTCACATCATAACTGTCTATAGGGCAATAAAATCTG
TGTTAAACTC
```

FIGURE 105

```
MIMKSNFDETYIENVVRNILKGQDVDSKEAQLISFLALLSSYVTDSTISVSQCEIFLGIIYTSTPWEPESLEDKM
GTYSTLLIKTEVAEYGRYTGVRIIHPLIALYCLKELERSYHLDKCQIALNILEENLFYDSGIGRDKFQHDVQTLL
LTRQRKVYGDETDTLFSPLMEALQNKDIEKVLSAGSRRFPQNAFICQALARHFYIKEKDFNTALDWARQAKMKAP
KNSYISDTLGQVYKSEIKWWLDGNKNCRSITVNDLTHLLEAAEKASRAFKESQRQTDSKNYETENWSPQKSQRRY
DMYNTACFLGEIEVGLYTIQILQLTPFFHKENELSKKHMVQFLSGKWTIPPDPRNECYLALSKFTSHLKNLQSDL
KRCFDFFIDYMVLLKMRYTQKEIAEIMLSKKVSRCFRKYTELFCHLDPCLLQSKESQLLQEENCRKKLEALRADR
FAGLLEYLNPNYKDATTMESIVNEYAFLLQQNSKKPMTNEKQNSILANIILSCLKPNSKLIQPLTTLKKQLREVL
QFVGLSHQYPGPYFLACLLFWPENQELDQDSKLIEKYVSSLNRSFRGQYKRMCRSKQASTLFYLGKRKGLNSIVH
KAKIEQYFDKAQNTNSLWHSGDVWKKNEVKDLLRRLTGQAEGKLISVEYGTEEKIKIPVISVYSGPLRSGRNIER
VSFYLGFSIEGPLAYDIEVI
```

FIGURE 106

```
GTTACAGCAACCCTAGACATGAGGTACTAGACACAGTACATCTACACATATGAAAATGAATCAACACAGAATGCA
GAAGTAGAACCCTTGCTAAGGACTACTGGGCATCTTCCCAGGACAGCAGCCAAAAGAGAACCACCACTTCCTCTC
CTGCCTCCTCCTTGCTCTCTCCTAGAGTCCAAACCCAAATGGGCCAGTTGGATCTGATGTTCGTCAGTTCTTTAC
TTCTATTTCCTGGGGTACTCAGGAGGGCACACACTATAGATAACTTGGGTTAGCTGCATAAAATTCAATGTCTCA
TTAAGTTGCATTAAACTGAGCTTAGATGTGTAAGTTTGCTAACGGATGGGTTTTTTTGTTAAGAACTATAGGATT
TATGGGACCAAGTCTAGCGAGTCCAGATATCAAAATCATTATAATGTTATATTTGCTGTTATTAGAATATAATAT
AGCTTATTATACAATAAATATGTAGACTGTAAAATATATTTCTCACTAGTACCTCCTATTTTCTTTCTCTGTTGA
AGTTTTTAAATCCCACAGATAATTAAATTGGCACCTTTATGCTTGTTCAAAAATTAAAATAATCTATTAAATAAG
TTCAAATTAAAGATTTTTACTTCAAATGACTGATTTGTGATTTGCTTTTAATTTCTTAAAATGTTACCACATAAT
TCATCTAAAGTATAAAAAGGAATAGCAAATTTTAGATGTTGTGCAGATATATAATGCTTGTGTCAGAATTATTAT
AATATTGATAATAAACTTTAGATATTGCTTC
```

YSNPRHEVLDTVHLHI

GGAGACCGGAGGTCTGAGCTGCAGCCACTACACAGGCCTGGAATTCTACCACAGGGAATTTGCAGCACGAGTCTC
TGGAAAAAGACAACCTCGCCCTGCGGAAGGAGATCCAGTCCCTGCAGGCCGAGCTGGCGTGGTGGAGCCGGACCC
TGCACGTGCATGAGCGCCTGTGCCCCATGGATTGTGCCTCCTGCTCAGCTCCAGGGCTCCTGGGCTGCTGGGACC
AGGCTGAGGGGCTCCTGGGCCCTGGCCCACAGGGACAACATGGCTGCCGGGAGCAGCTGGAGCTGTTCCAGACCC
CGGGTTCCTGTTACCCAGCTCAGCCGCTCTCTCCAGGTCCACAGCCTCATGATTCTCCCAGCCTCCTCCAGTGCC
CCCTGCCCTCACTGTCCCTTGGCCCCGCTGTGGTTGCTGAACCTCCTGTCCAGCTGTCCCCCAGCCCTCTCCTGT
TTGCCTCGCACACTGGTTCCAGCCTGCAGGGGTCTTCCTCTAAGCTCAGTGCCCTCCAGCCCAGCCTCACGGCCC
AAACTGCCCCTCCACAGCCCCTCGAGCTGGAGCATCCCACCAGAGGGAAGCTGGGGTCCTCTCCCGACAACCCTT
CCTCTGCCCTGGGGCTTGCACGTCTGCAGAGCAGGGAGCACAAACCTGCTCTCTCAGCAGCCACTTGGCAAGGGC
TGGTTGTGGATCCCAGCCCTCACCCTCTCCTGGCCTTTCCTCTGCTCTCCTCTGCTCAAGTCCACTTCTAACCTG
GTCTTCGGAGCTGGGTTGGCCCCTTCTTTGGGCTCAGGAAGCAGCCTTAGCACACGGGCCTCTCCTCCCTCACTA
CTGGGTGCTGCCCTGCGTGGCTGACCAGCTGGCCCAGGATTTCACAGTCGAAAAGGAAGCCACCACTGATGCCTC
CCACTGTGACAGGCCCTGTCACCACCAATATCTTATTTCAACCTCACAGTTGACCTGAGAAATCGAGATTATCAC
TCCACTTTTTCAGACAAGGAAACTGAGGCTCAGGGAAGCCAAGTGACAAGTCCAAGGTCACGAAGACTTTCTTGG
AGCCCGAAACACCACCCTCTGCTCCTCCTTCTCCTGTCCTGGCCCAGGCATCCTAGGGGCTGAAATCCTGGAAAC
CGTGGGCTGGTGTGAGAAGGTTTGCATGCTCAGAGCAGAGAAGGGCTCTCCCCACTGCTTCGTGATTCCAGGGCC
AGAGCCATGCAGTCCCAGAAACCCCAACCTAGCTGGGGCAGGTCCAGAGTCCAAGCCCTGGTGGGTAGAGGCCAA
GCAGAAGCCCTGAAGTGGACTCTTGCTTCCCCTAGTAGTGTTTTCAGTGCCAAGAAGCTGAAACTGTGAGCTGGA
GTTGGGGAGAGGTCTGGAAGAGGACCATCTGGGATTTCTACAGCCTGGGTACCCATAGCCACACCAAGGCTTCTG
GGAGATTCTGCAGGGTCAGCTTTCCAGGCTGTTCCCAAATAGCTCCCTGCCTCCCCACTGCCCCTAAAGCCACAG
CAGAAGAGCCATTCATCTCATAAACAAAAAGGAAGAGGAAAGAATGAGGAAGGACCCTGTGCAAGGTTATTTGCA
GGCAGGGATGGGCTTGTACCTGACAGCACCCACCCCTGTGTGGCCCCCAGGCCCTCATCACCCTCAGACCCCTCC
TAAGCAGTTCCCTCATTGCTCTTTGGACTAGGCTGACAGCAGGAAGAGCAGGGCCCATGACCGGGTGGAAGTTCA
GTTTTGGTGTCTGCTTCAAGAGGGGGTTTTACACTCTGATTCCAGGACAAGCACTCTGAGGCGGGTGGGGGAGAG
AAACCCTGGCTCTTCACCCAGGTTTCACACACATGTAAATGAAACACTATGTTAGTATCTAACACACTCCTGGAT
ACAGAACACAAGTCTTGGCACATATGTGATGGAAATAAAGTGTTTTGCAATCTTTAAAAAAAAAAAAAAAAAAA

FIGURE 109

MDCASCSAPGLLGCWDQAEGLLGPGPQGQHGCREQLELFQTPGSCYPAQPLSPGPQPHDSPSLLQCPLPSLSLGP
AVVAEPPVQLSPSPLLFASHTGSSLQGSSSKLSALQPSLTAQTAPPQPLELEHPTRGKLGSSPDNPSSALGLARL
QSREHKPALSAATWQGLVVDPSPHPLLAFPLLSSAQVHF

FIGURE 110

GAACCGTTTACTCGCTGCTGTGCCCATCTATCAGCAGGCTCCGGGCTGAAGATTGCTTCTCTTCTCTCCTCCAAG
GTCTAGTGACGGAGCCCGCGCGCGGCGCCACCATGCGGCAGAAGGCGGTATCGCTTTTCTTGTGCTACCTGCTGC
TCTTCACTTGCAGTGGGGTGGAGGCAGGTGAGAATGCGGGTAAGGATGCAGGTAAGAAAAAGTGCTCGGAGAGCT
CGGACAGCGGCTCCGGGTTCTGGAAGGCCCTGACCTTCATGGCCGTCGGAGGAGGACTCGCAGTCGCCGGGCTGC
CCGCGCTGGGCTTCACCGGCGCCGGCATCGCGGCCAACTCGGTGGCTGCCTCGCTGATGAGCTGGTCTGCGATCC
TGAATGGGGGCGGCGTGCCCGCCGGGGGGCTAGTGGCCACGCTGCAGAGCCTCGGGGCTGGTGGCAGCAGCGTCG
TCATAGGTAATATTGGTGCCCTGATGGGCTACGCCACCCACAAGTATCTCGATAGTGAGGAGGATGAGGAGTAGC
CAGCAGCTCCCAGAACCTCTTCTTCCTTCTTGGCCTAACTCTTCCAGTTAGGATCTAGAACTTTGCCTTTTTTTT
TTTTTTTTTTTTTTTGAGATGGGTTCTCACTATATTGTCCAGGCTAGAGTGCAGTGGCTATTCACAGATGCGA
ACATAGTACACTGCAGCCTCCAACTCCTAGCCTCAAGTGATCCTCCTGTCTCAACCTCCCAAGTAGGATTACAAG
CATGCGCCGACGATGCCCAGAATCCAGAACTTTGTCTATCACTCTCCCCAACAACCTAGATGTGAAAACAGAATA
AACTTCACCCAGAAAA

FIGURE 111

MRQKAVSLFLCYLLLFTCSGVEAGENAGKDAGKKKCSESSDSGSGFWKALTFMAVGGGLAVAGLPALGFTGAGIA
ANSVAASLMSWSAILNGGGVPAGGLVATLQSLGAGGSSVVIGNIGALMGYATHKYLDSEEDEE

FIGURE 112

ATGGAAGGAGACTTCTCGGTGTGCAGGAACTGTAAAAGACATGTAGTCTCTGCCAACTTCACCCTCCATGAGGCT
TACTGCCTGCGGTTCCTGGTCCTGTGTCCGGAGTGTGAGGAGCCTGTCCCCAAGGAAACCATGGAGGAGCACTGC
AAGCTTGAGCACCAGCAGGTTGGGTGTACGATGTGTCAGCAGAGCATGCAGAAGTCCTCGCTGGAGTTTCATAAG
GCCAATGAGTGCCAGGAGCGCCCTGTTGAGTGTAAGTTCTGCAAACTGGACATGCAGCTCAGCAAGCTGGAGCTC
CACGAGTCCTACTGTGGCAGCCGGACAGAGCTCTGCCAAGGCTGTGGCCAGTTCATCATGCACCGCATGCTCGCC
CAGCACAGAGATGTCTGTCGGAGTGAACAGGCCCAGCTCGGGAAAGGGGAAAGAATTTCAGCTCCTGAAAGGGAA
ATCTACTGTCATTATTGCAACCAAATGATTCCAGAAAATAAGTATTTCCACCATATGGGTAAATGTTGTCCAGAC
TCAGAGTTTAAGAAACACTTTCCTGTTGGAAATCCAGAAATTCTTCCTTCATCTCTTCCAAGTCAAGCTGCTGAA
AATCAAACTTCCACGATGGAGAAAGATGTTCGTCCAAAGACAAGAAGTATAAACAGATTTCCTCTTCATTCTGAA
AGTTCATCAAAGAAAGCACCAAGAAGCAAAAACAAAACCTTGGATCCACTTTTGATGTCAGAGCCCAAGCCCAGG
ACCAGCTCCCCTAGAGGAGATAAAGCAGCCTATGACATTCTGAGGAGATGTTCTCAGTGTGGCATCCTGCTTCCC
CTGCCGATCCTAAATCAACATCAGGAGAAATGCCGGTGGTTAGCTTCATCAAAAAGGAAAACAAGTGAGAAATTT
CAGCTAGATTTGGAAAAGGAAAGGTACTACAAATTCAAAAGATTTCACTTTTAACACTGGCATTCCTGCCTACTT
GCTGTGGTGGTCTTGTGAAAGGTGATGGGTTTTATTCGTTGGGCTTTAAAAGAAAAGGTTTGGCAGAACTAAAAA
CAAAACTCACGTATCATCTCAATAGATACAGAAAAGGCTTTTGATAAAATTCAACTTGACTTCATGTTAAAAACC
CTCAACAAACCAGGCGTCGAAGGAACATACCTCAAAATAATAAGAGCCATCTATGACAAAACCACAGCCAACATC
ATACTGAATGAGCAAAAGCTGGAGCATTACTCTTGAGAAGTAGAACAAGGCACTTCAGTCCTATTCAACATAGTA
CTGGAAGTCTCGCCACAGCAATCAGGCAAGAGAAAGAAGTAAAAGGCACCC

FIGURE 113

MEGDFSVCRNCKRHVVSANFTLHEAYCLRFLVLCPECEEPVPKETMEEHCKLEHQQVGCTMCQQSMQKSSLEFHK
ANECQERPVECKFCKLDMQLSKLELHESYCGSRTELCQGCGQFIMHRMLAQHRDVCRSEQAQLGKGERISAPERE
IYCHYCNQMIPENKYFHHMGKCCPDSEFKKHFPVGNPEILPSSLPSQAAENQTSTMEKDVRPKTRSINRFPLHSE
SSSKKAPRSKNKTLDPLLMSEPKPRTSSPRGDKAAYDILRRCSQCGILLPLPILNQHQEKCRWLASSKRKTSEKF
QLDLEKERYYKFKRFHF

FIGURE 114A

CAGGCAAGGCTTATCTGGTGAAAACTTTTTTGCTATGCTCAGAGGGTACCGAGTAGAAAATTATGACCCAAAAGG
GACCATTGCTTTGTGGTCATAATTTTCTACTCGGTACCCTCTGAGCATAGCAAATTATGACCACAAAGCAATGGT
CCCTTTTGGGTTCCCTGAATTTTTCCGCTGTGACCCTGCAATCTCTCCGAGCCTTCATGCAGCAGCACAGATTTC
TAGGGGAGAATTTGTCCGCATCTCAGGATTAGATTATGTGGACAGTGCCCTCCTGATGGGGAGAGACAGGGACAA
GCCTTTCAAACGGAGGTTGAAATCAGAGTCGGTGGAAACATCTCTCTTCCGAAAGCTTCGAACTGTTAAAAGTGA
GCACGAAACTTTCAAGTTCACGTCTGAGCTGGAGGAGAGCCGACTGGAGAGGGGCATTCGCCCTTGGAATTGTCA
GCGATGTTTTGCACATTATGATGTCCAGAGCATTTTGTTTAATATCAACGAAGCCATGGCTACGAGGGCTAATGT
GGGGAAAAGGAAAAACATAACCACTGGGGCATCTGCAGCATCCCAGACTCAGATGCCTACGGGCCAGACAGGCAA
CTGTGAGTCCCCTTTAGGGAGCAAGGAGGACCTCAACTCCAAAGAGAACCTGGATGCCGATGAGGGTGATGGGAA
AAGTAACGACCTCGTCCTTAGTTGTCCTTACTTTAGAAATGAGACTGGAGGGGAAGGCGACAGGCGGATTGCGCT
CTCTCGAGCCAACTCATCCTCTTTCAGTTCTGGGGAAAGCTGCTCTTTCGAATCGTCACTCAGCTCTCACTGCAC
AAATGCAGGTGTCTCCGTCTTGGAAGTGCCCAGAGAAAACCAGCCTATTCACAGGGAGAAAGTGAAGCGCTACAT
CATAGAACACATTGACCTTGGGGCCTATTATTACCGCAAATTCTTCTATGGGAAAGAGCACCAAAACTACTTTGG
AATAGATGAAAACCTTGGTCCAGTAGCAGTCAGCATCCGGAGAGAGAAGGTGGAAGATGCCAAGGAGAAAGAAGG
ATCCCAGTTCAACTACAGGGTGGCTTTCAGGACAAGTGAGCTTACAACACTGAGAGGAGCAATTTTAGAAGATGC
TATACCCTCTACTGCTAGGCATGGTACCGCACGAGGACTACCTCTCAAAGAAGTTTTGGAATACGTCATTCCAGA
GCTGAGCATTCAGTGTTTGCGACAGGCTTCCAACTCACCCAAGGTCTCAGAGCAGCTGCTCAAGCTTGATGAACA
AGGGCTGAGCTTTCAGCACAAGATCGGGATCCTTTATTGCAAAGCAGGCCAGAGCACAGAGGAAGAGATGTATAA
CAATGAGACGGCGGGACCAGCTTTTGAAGAATTCCTTGATCTTCTGGGCCAGAGAGTCCGACTGAAAGGATTTAG
TAAATATCGAGCTCAGCTAGACAATAAGACTGATTCCACGGGCACGCACTCTCTCTATACCACATACAAAGACTA
CGAACTCATGTTCCACGTGTCAACCCTGCTTCCCTACATGCCCAACAACAGACAACAGCTACTGAGGAAAAGGCA
CATAGGAAATGACATCGTCACCATCGTCTTCCAGGAGCCTGGGGCACTTCCTTTTACTCCAAAAAGCATCCGGTC
TCACTTTCAGCATGTCTTTGTCATAGTCAAAGTGCATAATCCATGTACCGAAAATGTGTGTTATAGTGTTGGAGT
TTCCAGATCAAAAGATGTGCCACCATTTGGCCCACCGATTCCCAAAGGTGTAACTTTTCCAAAGTCAGCCGTGTT
CCGGGACTTCCTTTTAGCCAAAGTAATCAATGCAGAAAATGCAGCCCATAAATCAGAAAAGTTTCGAGCAATGGC
CACTCGAACGAGGCAGGAGTACTTGAAAGATCTGGCGGAGAACTTTGTCACAACCGCCACCGTGGATACCTCTGT
GAAGTTCAGCTTCATTACGCTGGGTGCGAAGAAAAAGGAGAAGGTAAAGCCAAGGAAGGATGCCCACTTGTTTAG
CATTGGGGCCATCATGTGGCACGTGATAGCCCGGGACTTCGGCCAGTCTGCTGACATTGAATGTCTTCTCGGGAT
CTCCAATGAGTTCATCATGTTGATTGAAAAGGATTCCAAGAATGTTGTATTCAACTGTTCCTGCAGGGATGTGAT
TGGGTGGACATCTGGATTAGTGAGTATCAAAGTGTTTTACGAAAGAGGAGAATGTGTCCTCCTGTCCTCGGTAGA
CAACTGTGCTGAAGACATCAGGGAAATTGTTCAGCGATTAGTAATAGTGACGAGAGGCTGCGAGACTGTGGAAAT
GACCCTGAGGAGGAACGGGCTGGGCCAGCTTGGCTTCCATGTGAATTTTGAAGGAATTGTCGCAGATGTGGAACC
TTTTGGCTTTGCCTGGAAGGCTGGCCTTCGCCAAGGGAGCCGCCTCGTGGAGATCTGCAAAGTAGCCGTGGCCAC
TCTGACCCACGAGCAGATGATCGACCTGCTCCGTACTTCTGTGACTGTGAAGGTGGTCATCATCCAGCCCCATGA
TGACGGCTCGCCCCGAAGAGGGTGTTCAGAGCTCTGCCGGATCCCTATGGTGGAATATAAACTCGACAGCGAGGG
CACCCCCTGCGAGTATAAAACCCCCTTCAGGAGGAACACTACGTGGCACCGGGTGCCCACTCCTGCCCTGCAGCC
CCTCTCTAGAGCTTCCCCCATCCCCGGCACGCCCGACCGGCTGCCGTGCCAACAGCTGCTCCAGCAGGCCCAGGC
TGCCATTCCTCGAAGCACCTCCTTCGACCGGAAGCTGCCCGATGGCACGAGAAGCTCACCCAGCAACCAGTCATC
CTCCAGCGACCCTGGACCCGGCGGGAGCGGACCCTGGAGACCACAAGTGGGCTACGACGGGTGCCAGTCCCCTCT
ACTGCTCGAACACCAGGGCTCAGGCCCTTTGGAATGTGACGGAGCCAGGGAGAGGGAAGACACCATGGAAGCAAG
CAGGCACCCGGAAACCAAATGGCATGGCCCACCTTCCAAAGTCCTGGGTTCCTATAAAGAAAGAGCTCTGCAGAA
AGATGGAAGTTGCAAAGATTCCCCCAATAAGCTTTCTCACATTGGGGATAAAAGTTGCTCCAGTCACTCCAGCAG
CAACACGCTCTCCAGCAACACCTCCAGCAACAGTGACGACAAGCACTTTGGGTCTGGCGACCTGATGGACCCCGA
ATTACTGGGGCTGACCTACATCAAAGGGCCTCCACCGACAGTGGCATCGACACGGCCCCTGCATGCCTGCCAC
CATCCTCGGCCCTGTGCACCTGGCAGGCAGCAGGTCCCTGATCCACAGCCGGGCCGAGCAGTGGGCTGATGCTGC
CGACGTCTCTGGGCCTGACGACGAGCCAGCCAAGTTATATTCTGTGCATGGCTACGCGTCCGCCATCTCCGCCGG
CAGTGCTGCGGAAGGCAGCATGGGCGATCTCAGTGAGATATCCTCTCATTCCAGTGGTTCTCACCATTCAGGAAG
CCCTTCAGCTCACTGTTCAAAAAGTAGTGGGTCTCTGGATTCATCCAAAGTCTACATCGTGTCTCACAGCAGCGG

FIGURE 114B

```
ACAACAGGTTCCCGGGTCCATGTCCAAGCCCTACCACAGACAAGGGGCAGTGAACAAATATGTCATCGGCTGGAA
GAAATCGGAGGGCAGCCCACCGCCCGAGGAGCCTGAAGTGACTGAATGTCCCGGGATGTATAGTGAGATGGATGT
CATGTCCACAGCAACTCAGCATCAGACAGTGGTGGGAGATGCTGTTGCAGAGACTCAACATGTTCTGTCTAAAGA
AGATTTTCTGAAATTGATGCTTCCTGACAGCCCCTTAGTGGAGGAGGGGCGAAGAAAGTTTTCGTTCTATGGGAA
CCTGTCTCCAAGGAGGTCGCTTTACCGCACGCTGTCTGACGAGAGCATCTGCAGCAACAGGAGGGGGTCCTCCTT
TGGCAGTTCCCGGAGTTCCGTGCTTGACCAGGCCCTGCCCAACGACATTCTGTTCAGCACCACCCCACCCTACCA
CAGCACGCTGCCTCCGCGGGCCCACCCCGCACCCAGCATGGGGAGCCTGAGAAATGAGTTCTGGTTCTCCGATGG
GTCCTTATCAGATAAGTCCAAGTGCGCAGATCCTGGCCTGATGCCCCTCCCGGACACAGCCACAGGGTTAGATTG
GACCCACCTCGTGGATGCTGCACGGGCATTTGAAGGTCTTGACTCAGATGAAGAACTGGGGCTGCTCTGTCACCA
CACGTCCTATCTAGACCAGAGGGTGGCATCCTTCTGCACCCTGACAGATATGCAGCATGGGCAGGACCTGGAAGG
GGCCCAAGAGCTGCCCTTATGTGTAGATCCAGGCAGTGGCAAAGAGTTCATGGACACAACTGGGGAGCGTTCTCC
ATCACCACTGACCGGGAAAGTCAATCAGCTGGAATTAATTCTTCGACAACTCCAGACCGACCTTCGGAAGGAAAA
ACAAGACAAGGCCGTTCTCCAAGCAGAAGTGCAGCACCTGAGACAGGACAACATGAGACTGCAGGAGGAGTCCCA
GACCGCGACAGCTCAGCTGCGGAAATTCACAGAATGGTTTTTCACCACCATCGACAAAAAATCTTAGCCAATCCG
CACCTCATCAAGGGACCACTGGGAAATGCCCCTTGTCCCTTTGAAGTCACAAAGATGTGGTTTTTCTGTGTGCTT
TCAACCAATCGTAGATGTTTTGCTGTTCCATTCTGTGTAGCACCATTCACCACAGCAGGATAGGGAGCCTCGAC
TCTTTCTCGGTAACCACGGCAGAGAGCAGCGCCGATGTGAAGATGAATGAATGTAACTCCTGGTGTGAAGATGAA
TGTAAACCCTGGCGACAGTTGAGACCTTTTTCTTTTAGACTCTGCTAAAACAGTGCTCTGGCTTGGGCTTACCTC
AAGAGGGAAGATAGTTGAGTTTTATTTCCTGTATATCAGGTGACCTGGTAGAGATGTAAAGCAATTTACCATAGT
TTGGGCTTTAGTATTGTAAAATAAACATGAGAACAAATAATCAGACATATACTTTAATGTTAAAGGTGCTCTATT
TTTTTGGATGTACAGTAGTTTTATTTCCACAGCCACATTACCATAGCAATAAGAAAGGAGGCATAGTACATAGTT
GGAAAAGCTTTGTGGGGGGATTAAAAAAAAAAAAAAGCACTGTTGTGTTTAACACTAGTTCAGATGCAGTTACCT
TAGAGACTTATTTATTTGCAGGAACAAATGGTGCCTGAATATTAACAGTGTTCTGATTAAAAACAAAAAAAAGAT
ACATATGCCTTGTAAATGGCTCACCGAGTGGTCAGTAGTCACTTCAACTCTTAGTTCACTTTTGTATAGTTGCTC
TGCTGGAAAGAAATGAGAGTGAATCTGCTTACTCACTAGAACTTCCCTGTGTGCTGTGAGCCAGCGGAACCACTT
GTACAATGCCAGATTTGTTTATCTTTGTACAGAAGCTTTGATGAAGTGTCTTGTATTTAACACCCTTATTTAAGC
TTATTTAACCTTAAATTGTTAATTTTATAAAATTTGGTTTGGCCTGCACTACGATGAGGGATGGAGGTAGCTGCA
GGCTCAGAAGAGACTGAGCTTGCACAGATCAGACCGAGAAGCAGGGTGAGAGATTCTAACGACTGGATGCTGCTA
GTAACACATTGTTTGTATTGCTTTACCATTTTTAACTGTTAGATTTGAGATGAACATACATTTTGCTTTTTTAAT
AAATGTTTAAAAGAAGTCCACATAAG
```

FIGURE 115

```
FSTRYPLSIANYDHKAMVPFGFPEFFRCDPAISPSLHAAAQISRGEFVRISGLDYVDSALLMGRDRDKPFKRRLK
SESVETSLFRKLRTVKSEHETFKFTSELEESRLERGIRPWNCQRCFAHYDVQSILFNINEAMATRANVGKRKNIT
TGASAASQTQMPTGQTGNCESPLGSKEDLNSKENLDADEGDGKSNDLVLSCPYFRNETGGEGDRRIALSRANSSS
FSSGESCSFESSLSSHCTNAGVSVLEVPRENQPIHREKVKRYIIEHIDLGAYYYRKFFYGKEHQNYFGIDENLGP
VAVSIRREKVEDAKEKEGSQFNYRVAFRTSELTTLRGAILEDAIPSTARHGTARGLPLKEVLEYVIPELSIQCLR
QASNSPKVSEQLLKLDEQGLSFQHKIGILYCKAGQSTEEEMYNNETAGPAFEEFLDLLGQRVRLKGFSKYRAQLD
NKTDSTGTHSLYTTYKDYELMFHVSTLLPYMPNNRQQLLRKRHIGNDIVTIVFQEPGALPFTPKSIRSHFQHVFV
IVKVHNPCTENVCYSVGVSRSKDVPPFGPPIPKGVTFPKSAVFRDFLLAKVINAENAAHKSEKFRAMATRTRQEY
LKDLAENFVTTATVDTSVKFSFITLGAKKKEKVKPRKDAHLFSIGAIMWHVIARDFGQSADIECLLGISNEFIML
IEKDSKNVVFNCSCRDVIGWTSGLVSIKVFYERGECVLLSSVDNCAEDIREIVQRLVIVTRGCETVEMTLRRNGL
GQLGFHVNFEGIVADVEPFGFAWKAGLRQGSRLVEICKVAVATLTHEQMIDLLRTSVTVKVVIIQPHDDGSPRRG
CSELCRIPMVEYKLDSEGTPCEYKTPFRRNTTWHRVPTPALQPLSRASPIPGTPDRLPCQQLLQQAQAAIPRSTS
FDRKLPDGTRSSPSNQSSSSDPGPGGSGPWRPQVGYDGCQSPLLLEHQGSGPLECDGAREREDTMEASRHPETKW
HGPPSKVLGSYKERALQKDGSCKDSPNKLSHIGDKSCSSHSSSNTLSSNTSSNSDDKHFGSGDLMDPELLGLTYI
KGASTDSGIDTAPCMPATILGPVHLAGSRSLIHSRAEQWADAADVSGPDDEPAKLYSVHGYASAISAGSAAEGSM
GDLSEISSHSSGSHHSGSPSAHCSKSSGSLDSSKVYIVSHSSGQQVPGSMSKPYHRQGAVNKYVIGWKKSEGSPP
PEEPEVTECPGMYSEMDVMSTATQHQTVVGDAVAETQHVLSKEDFLKLMLPDSPLVEEGRRKFSFYGNLSPRRSL
YRTLSDESICSNRRGSSFGSSRSSVLDQALPNDILFSTTPPYHSTLPPRAHPAPSMGSLRNEFWFSDGSLSDKSK
CADPGLMPLPDTATGLDWTHLVDAARAFEGLDSDEELGLLCHHTSYLDQRVASFCTLTDMQHGQDLEGAQELPLC
VDPGSGKEFMDTTGERSPSPLTGKVNQLELILRQLQTDLREKQDKAVLQAEVQHLRQDNMRLQEESQTATAQLR
KFTEWFFTTIDKKS
```

FIGURE 116

```
GCCTAAAGGCAGGGCCCTCATGACTCTATCACCTACCAAAAGGCTCCACTTCTTTATACTATTGGAGGGGTAGAA
GGAACTTCCTTTCTAGACCTTGAAGGTTTAAGAATTTGAATCTATAAAACAAGCTGACAATAGACAGATTAACAG
GAGAAAAAGCATATACATTTTTTAATGTGGGCCAGATGGCAGAAGCTTAAATAACACCCCAAGCTACAGGAAGTG
AGGCCTCTGATGGGGAGGTAGTGACACAGGCTGTGGGAGGGGGTAGGGGGAGGAAGTCTGTGGTGAGCAAAGTTT
GCCTTATTACACTGATAAAGTGTAATTACACTAATAAA
```

FIGURE 117

PKGRALMTLSPTKRLHFFILLEG

FIGURE 118

TATGTGGACTTGTTTTCATTTCTCTTGGATGTATATTCCTAGGAGAATGGCTGGATTATACAGTAACTCTTTCCT
CATAACTTTGCATATCAAAATTATATCCATCTTTCAGAACCCAAATTCAGTGTTATTTCCAAAGTGTTCCAACAT
CTCCCACTCAAAATGAATCTTCTCCCTAGTACTCCCATTGTTTAGTACCTAATTGTTCTTACCAGTTTGTCTTAG
AGCTCAGTCATTCCTACACAGCACTTTTCTTCATTATACTGCTAATTTCATTACACTGTAAGAGTGGGGACAAGC
TGTTCTTCTTGTATACCAGAAAGTAGTGAGTGCACTGCTGTGAAGAAAGCAGGAACTCAAAAGTTAAGAATTTTG
AATGAGCCTATAAAATGTGTCTAATAAATAATAATGTTCATTTTCAAATCTCAACAATTAAATGTTTAACAAATA
ACACTTGAAATAAATGTTTATTAGAAAAACCAAAAAAATCTATGTCGGTGCGGAGAAAGAGGGTAATGAAATGGC
AGGAATTCGATATCAGC

FIGURE 119

MWTCFHFSWMYIPRRMAGLYSNSFLITLHIKIISIFQNPNSVLFPKCSNISHSK

FIGURE 120

GAAATTCTTACAAAAACTGAAAGTGAAATGAGGAAGACAGATTGAGCAATCCAATCGGAGGGTAAATGCCAGCAA
ACCTACTGTACAGTAGGGGTAGAGATGCAGAAAGGCAGAAAGGAGAAAATTCAGGATAACTCTCCTGAGGGGTGA
GCCAAGCCCTGCCATGTAGTGCACGCAGGACATCAACAAACACAGATAACAGGAAATGATCCATTCCCTGTGGTC
ACTTATTCTAAAGGCCCCAACCTTCAAAGTTCAAGTAGTGATATGGATGACTCCACAGAAAGGGAGCAGTCACGC
CTTACTTCTTGCCTTAAGAAAAGAGAAGAAATGAAACTGAAGGAGTGTGTTTCCATCCTCCCACGGAAGGAAAGC
CCCTCTGTCCGATCCTCCAAAGACGGAAAGCTGCTGGCTGCAACCTTGCTGCTGGCACTGCTGTCTTGCTGCCTC
ACGGTGGTGTCTTTCTACCAGGTGGCCGCCCTGCAAGGGGACCTGGCCAGCCTCCGGGCAGAGCTGCAGGGCCAC
CACGCGGAGAAGCTGCCAGCAGGAGCAGGAGCCCCAAGGCCGGCCTGGAGGAAGCTCCAGCTGTCACCGCGGGA
CTGAAAATCTTTGAACCACCAGCTCCAGGAGAAGGCAACTCCAGTCAGAACAGCAGAAATAAGCGTGCCGTTCAG
GGTCCAGAAGAAACAGTCACTCAAGACTGCTTGCAACTGATTGCAGACAGTGAAACACCAACTATACAAAAAGGA
TCTTACACATTTGTTCCATGGCTTCTCAGCTTTAAAAGGGGAAGTGCCCTAGAAGAAAAAGAGAATAAAATATTG
GTCAAAGAAACTGGTTACTTTTTTATATATGGTCAGGTTTTATATACTGATAAGACCTACGCCATGGGACATCTA
ATTCAGAGGAAGAAGGTCCATGTCTTTGGGGATGAATTGAGTCTGGTGACTTTGTTTCGATGTATTCAAAATATG
CCTGAAACACTACCCAATAATTCCTGCTATTCAGCTGGCATTGCAAAACTGGAAGAAGGAGATGAACTCCAACTT
GCAATACCAAGAGAAAATGCACAAATATCACTGGATGGAGATGTCACATTTTTTGGTGCATTGAAACTGCTGTGA

CCTACTTACACCATGTCTGTAGCTATTTTCCTCCCTTTCTCTGTACCTCTAAGAAGAAAGAATCTAACTGAAAAT
ACCA

FIGURE 121

MDDSTEREQSRLTSCLKKREEMKLKECVSILPRKESPSVRSSKDGKLLAATLLLALLSCCLTVVSFYQVAALQGD
LASLRAELQGHHAEKLPAGAGAPKAGLEEAPAVTAGLKIFEPPAPGEGNSSQNSRNKRAVQGPEETVTQDCLQLI
ADSETPTIQKGSYTFVPWLLSFKRGSALEEKENKILVKETGYFFIYGQVLYTDKTYAMGHLIQRKKVHVFGDELS
LVTLFRCIQNMPETLPNNSCYSAGIAKLEEGDELQLAIPRENAQISLDGDVTFFGALKLL

FIGURE 122

```
TTAATATACAATTTTTATTTGTCAATTAGAAAGTAACAATAAAGAGTGAGCTTATAAGTTATGGAGTTAAAATTT
TATGCAGAAGCAAGGGAAAATCTTCCTCCAGTGAAAAAATTCTAATGAGATTTTGAAGACAGAAACAAATCACAT
TTTTTTGTTTTGTTTTCTAAATGTTTTACAAGAGAAAATTTCAAAAGCATAATCAGTAAGAGGGAGAAAAGTG
TGCTGAATTCCATGTATCCAGCTTGCAGCCATTGTTAACTCAGGACTAATCTTGTTTCGGTTCTACTTCCCTTTC
ACCACCCCCACACCCCAAACACAAAATTACTGATTCTAGATCATGTCATTTATTTACAAATACTTTAGTATGTAT
C
```

FIGURE 123

```
CTCTACAAGTACTTCTATGCCATCTCCAACATCGAGGTCATCGGCAGGTGCAAGTGCAACCTGCACGCCAACCTG
TGCTCCATGCGCGAGGGCAGCCTGCAGTGCGAGTGCGAGCACAACACCACCGGCCCCGACTGCGGCAAGTGCAAG
AAGAATTTCCGCACCCGGTCCTGGCGGGCCGGCTCCTACCTGCCGCTGCCCCATGGCTCTCCCAACGCCTGTGCC
GCTGCAGGTTCCTTTGGCAACTGCGAATGCTACGGTCACTCCAACCGCTGCAGCTACATTGACTTCCTGAATGTG
GTGACCTGCGTCAGCTGCAAGCACAACACGCGAGGTCAGCACTGCCAGCACTGCCGGCTGGGCTACTACCGCAAC
GGCTCGGCAGAGCTGGATGATGAGAACGTCTGCATTGAGTGTAACTGCAACCAGATAGGCTCCGTGCACGACCGG
TGCAACGAGACCGGCTTCTGCGAGTGCCGCGAGGGCGCGGCGGGCCCCAAGTGCGACGACTGCCTCCCCACGCAC
TACTGGCGCCAGGGCTGCTACCCCAACGTGTGCGACGACGACCAGCTGCTGTGCCAGAACGGAGGCACCTGCCTG
CAGAACCAGCGCTGCGCCTGCCCGCGCGGCTACACCGGCGTGCGCTGCGAGCAGCCCCGCTGCGACCCCGCCGAC
GATGACGGCGGTCTGGACTGCGACCGCGCGCCCGGGGCCGCCCCGCGCCCCGCCACCCTGCTCGGCTGCCTGCTG
CTGCTGGGGCTGGCCGCCCGCCTGGGCCGCTGAGCCCCGCCCGGAGGACGCTCCCCGCACCCGGAGGCCGGGGGT
CCCGGGGTCCCGGGGCGGGGCCGGCGTCCGAGGCCGGGCGGTGAGAAGGGTGCGGCCCGAGGTGCTCCCAGGTGC
TACTCAGCAGGGCCCCCCGCCCGGCCCGCGCTCCCGCCCGCACTGCCCTCCCCCCGCAGCAGGGGCGCCTTGGGA
CTCCGGTCCCCGCGCCTGCGATTTGGTTTCGTTTTTCTTTTGTATTATCCGCCGCCCAGTTCCTTTTTGTCTTT
CTCTCTCTCTCTTTTTTTTTTTTTTTCTGGCGGTGAGCCAGAGGGTCGGGAGAAACGCTGCTCGCCCCACACC
CCGTCCTGCCTCCCACCACACTTACACACACGGGACTGTGGCCGACACCCCCTGGCCTGTGCCAGGCTCACGGGC
GGCGGCGGACCCCGACCTCCAGTTGCCTACAATTCCAGTCGCTGACTTGGTCCTGTTTTCTATTCTTTATTTTC
CTGCAACCCACCAGACCCCAGGCCTCACCGGAGGCCCGGTGACCACGGAACTCACCGTCTGGGGGAGGAGGAGAG
AAGGAAGGGGTGGGGGGCCTGGAAACTTCGTTCTGTAGAGAACTATTTTTGTTTGTATTCACTGTCCCCTGCAAG
GGGGACGGGGCGGGAGCACTGGTCACCGCGGGGGCCGATGGTGGAGAATCCGAGGAGTAAAGAGTTTGCTCACTG
CTGCCAAAAAAAAAAAAAAAAAAAAAAAA
```

FIGURE 124

```
GACTCCTAGGGGCTTGCAGACCTAGTGGGAGAGAAAGAACATCGCAGCAGCCAGGCAGAACCAGGACAGGTGAGG
TGCAGGCTGGCTTTCCTCTCGCAGCGCGGTGTGGAGTCCTGTCCTGCCTCAGGGCTTTTCGGAGCCTGGATCCTC
AAGGAACAAGTAGACCTGGCCGCGGGGAGTGGGGAGGGAAGGGGTGTCTATTGGGCAACAGGGCGGCAAAGCCCT
GAATAAAGGGGCGCAGGGCAGGCGCAAGTGCAGAGCCTTCGTTTGCCAAGTCGCCTCCAGACCGCAGACATGAAA
CTTGTCTTCCTCGTCCTGCTGTTCCTCGGGGCCCTCGGACTGTGTCTGGCTGGCCGTAGGAGAAGGAGTGTTCAG
TGGTGCGCCGTATCCCAACCCGAGGCCACAAAATGCTTCCAATGGCAAAGGAATATGAGAAAAGTGCGTGGCCCT
CCTGTCAGCTGCATAAAGAGAGACTCCCCCATCCAGTGTATCCAGGCCATTGCGGAAAACAGGGCCGATGCTGTG
ACCCTTGATGGTGGTTTCATATACGAGGCAGGCCTGGCCCCCTACAAACTGCGACCTGTAGCGGCGGAAGTCTAC
GGGACCGAAAGACAGCCACGAACTCACTATTATGCCGTGGCTGTGGTGAAGAAGGGCGGCAGCTTTCAGCTGAAC
GAACTGCAAGGTCTGAAGTCCTGCCACACAGGCCTTCGCAGGACCGCTGGATGGAATGTCCCTACAGGGACACTT
CGTCCATTCTTGAATTGGACGGGTCCACCTGAGCCCATTGAGGCAGCTGTGGCCAGGTTCTTCTCAGCCAGCTGT
GTTCCCGGTGCAGATAAAGGACAGTTCCCCAACCTGTGTCGCCTGTGTGCGGGGACAGGGGAAAACAAATGTGCC
TTCTCCTCCCAGGAACCGTACTTCAGCTACTCTGGTGCCTTCAAGTGTCTGAGAGACGGGGCTGGAGACGTGGCT
TTTATCAGAGAGAGCACAGTGTTTGAGGACCTGTCAGACGAGGCTGAAAGGGACGAGTATGAGTTACTCTGCCCA
GACAACACTCGGAAGCCAGTGGACAAGTTCAAAGACTGCCATCTGGCCCGGGTCCCTTCTCATGCCGTTGTGGCA
CGAAGTGTGAATGGCAAGGAGGATGCCATCTGGAATCTTCTCCGCCAGGCACAGGAAAAGTTTGGAAAGGACAAG
TCACCGAAATTCCAGCTCTTTGGCTCCCCTAGTGGGCAGAAAGATCTGCTGTTCAAGGACTCTGCCATTGGGTTT
TCGAGGGTGCCCCCGAGGATAGATTCTGGGCTGTACCTTGGCTCCGGCTACTTCACTGCCATCCAGAACTTGAGG
AAAAGTGAGGAGGAAGTGGCTGCCCGGCGTGCGCGGGTCGTGTGGTGTGCGGTGGGCGAGCAGGAGCTGCGCAAG
TGTAACCAGTGGAGTGGCTTGAGCGAAGGCAGCGTGACCTGCTCCTCGGCCTCCACCACAGAGGACTGCATCGCC
CTGGTGCTGAAAGGAGAAGCTGATGCCATGAGTTTGGATGGAGGATATGTGTACACTGCATGCAAATGTGGTTTG
GTGCCTGTCCTGGCAGAGAACTACAAATCCCAACAAAGCAGTGACCCTGATCCTAACTGTGTGGATAGACCTGTG
GAAGGATATCTTGCTGTGGCGGTGGTTAGGAGATCAGACACTAGCCTTACCTGGAACTCTGTGAAAGGCAAGAAG
TCCTGCCACACCGCCGTGGACAGGACTGCAGGCTGGAATATCCCCATGGGCCTGCTCTTCAACCAGACGGGCTCC
TGCAAATTTGATGAATATTTCAGTCAAAGCTGTGCCCCTGGGTCTGACCCGAGATCTAATCTCTGTGCTCTGTGT
ATTGGCGACGAGCAGGGTGAGAATAAGTGCGTGCCCAACAGCAACGAGAGATACTACGGCTACACTGGGGCTTTC
CGGTGCCTGGCTGAGAATGCTGGAGACGTTGCATTTGTGAAAGATGTCACTGTCTTGCAGAACACTGATGGAAAT
AACAATGAGGCATGGGCTAAGGATTTGAAGCTGGCAGACTTTGCGCTGCTGTGCCTCGATGGCAAACGGAAGCCT
GTGACTGAGGCTAGAAGCTGCCATCTTGCCATGGCCCCGAATCATGCCGTGGTGTCTCGGATGGATAAGGTGGAA
CGCCTGAAACAGGTGCTGCTCCACCAACAGGCTAAATTTGGGAGAAATGGATCTGACTGCCCGGACAAGTTTTGC
TTATTCCAGTCTGAAACCAAAAACCTTCTGTTCAATGACAACACTGAGTGTCTGGCCAGACTCCATGGCAAAACA
ACATATGAAAAATATTTGGGACCACAGTATGTCGCAGGCATTACTAATCTGAAAAAGTGCTCAACCTCCCCCCTC
CTGGAAGCCTGTGAATTCCTCAGGAAGTAAAACCGAAGAAGATGGCCCAGCTCCCAAGAAAGCCTCAGCCATTC
ACTGCCCCAGCTCTTCTCCCCAGGTGTGTTGGGGCCTTGGCTCCCCTGCTGAAGGTGGGGATTGCCCATCCATC
TGCTTACAATTCCCTGCTGTCGTCTTAGCAAGAAGTAAAATGAGAAATTTTGTTGATATTCAAAAAAA
```

FIGURE 125

MKLVFLVLLFLGALGLCLAGRRRRSVQWCAVSQPEATKCFQWQRNMRKVRGPPVSCIKRDSPIQCIQAIAENRAD
AVTLDGGFIYEAGLAPYKLRPVAAEVYGTERQPRTHYYAVAVVKKGGSFQLNELQGLKSCHTGLRRTAGWNVPTG
TLRPFLNWTGPPEPIEAAVARFFSASCVPGADKGQFPNLCRLCAGTGENKCAFSSQEPYFSYSGAFKCLRDGAGD
VAFIRESTVFEDLSDEAERDEYELLCPDNTRKPVDKFKDCHLARVPSHAVVARSVNGKEDAIWNLLRQAQEKFGK
DKSPKFQLFGSPSGQKDLLFKDSAIGFSRVPPRIDSGLYLGSGYFTAIQNLRKSEEEVAARRARVVWCAVGEQEL
RKCNQWSGLSEGSVTCSSASTTEDCIALVLKGEADAMSLDGGYVYTACKCGLVPVLAENYKSQQSSDPDPNCVDR
PVEGYLAVAVVRRSDTSLTWNSVKGKKSCHTAVDRTAGWNIPMGLLFNQTGSCKFDEYFSQSCAPGSDPRSNLCA
LCIGDEQGENKCVPNSNERYYGYTGAFRCLAENAGDVAFVKDVTVLQNTDGNNNEAWAKDLKLADFALLCLDGKR
KPVTEARSCHLAMAPNHAVVSRMDKVERLKQVLLHQQAKFGRNGSDCPDKFCLFQSETKNLLFNDNTECLARLHG
KTTYEKYLGPQYVAGITNLKKCSTSPLLEACEFLRK

FIGURE 126

```
GCTGACACCTGCCCAGTGGAAGCTGGCATCCCTCCCCTTGTGGGTTCAGAGCTGCAAGAAGCACCAGGCTCGGCC
ACTTCAGAAGCCCCAGCCTCGACCTAGCCCACCCTCTCAGGGCCACAGTGCAGAAGCCTGCACACCTGCCAAGTC
TCTCCGACTCCTTGCAGCTGCTGTCAGCATGGCCCAGGCTCCTGCTGACCCGGGCAGAGAAGGCCACCTTGAACA
AAGAATCCTGCAGGTGCTGACAGAGGCTGGCTCCCCGGTGAAACTTGCCCAGCTGGTGAAGGAATGCCAAGCACC
CAAGAGGGAGCTCAACCAAGTCCTCTACCGAATGAAAAAGGAGTTGAAAGTCTCCCTCACATCCCCTGCCACCTG
GTGCTTGGGCGGGACTGATCCTGAAGGCGAGGGTCCTGCAGAGCTGGCCTTGTCCAGCCCTGCCGAGAGGCCCCA
GCAACATGCAGCTACAATTCCAGAGACCCCTGGCCCTCAGTTCAGCCAACAACGGGAGGAAGACATCTACAGGTT
TCTCAAAGACAATGGTCCCCAGAGGGCCCTGGTCATCGCCCAAGCACTGGGAATGAGGACAGCAAAAGATGTGAA
CCGAGACTTGTACAGGATGAAGAGCAGGCACCTTCTGGACATGGATGAGCAGTCCAAAGCATGGACGATTTACCG
CCCAGAAGATTCTGGAAGAAGAGCAAAGTCAGCCTCAATTATTTACCAGCACAATCCAATCAACATGATCTGCCA
GAATGGACCCAACAGCTGGATTTCCATTGCAAACTCCGAAGCCATCCAGATTGGACACGGGAACATCATTACAAG
ACAGACAGTCTCCAGGGAGGACGGTTCCGCCGGTCCACGCCACCTCCCTTCAATGGCACCAGGTGATTCCTCAAC
TTGGGGGACCCTAGTTGATCCCTGGGGGCCCCAGGACATCCACATGGAGCGGTCCATACTGAGACGGGTGCAGCT
GGGACACAGCAATGAGATGAGGCTCCACGGCGTCCCGTCCGAGGGCCCTGCCCACATCCCCCCTGGCAGCCCCC
AGTCTCTGCCACTGCTGCCGGCCCAGAAGCTTCGTTTGAAGCAAGAATTCCCAGTCCAGGAACTCACCCTGAGGG
GGAAGCCGCCCAGAGAATCCACATGAAATCGTGCTTTCTCGAGGACGCCACCATCGGCAACAGCAACAAAATGTC
TATCAGCCCAGGGGTGGCTGGCCCAGGAGGAGTCGCAGGGTCTGGAGAGGGGGAGCCAGGGGAGGACGCAGGTCG
TCGTCCCGCAGACACACAATCCAGAAGTCACTTTCCTCGAGACATTGGTCAGCCCATCACTCCCAGCCACTCGAA
GCTCACCCCCAAGCTGGAAACTATGACTCTTGGAAACAGGAGTCACAAAGCTGCAGAAGGCAGCCACTATGTGGA
TGAAGCCTCACACGAGGGGAGCTGGTGGGGAGGTGGGATTTAGTGCACAGCCTCACGTGGGCTTGGACACAGGC
TGGGGGTGGGCGCATGCTAGGGAGACTAGCCTGCTGCTCTCTGCATTCCTTAGCGTCTTGTTTGACCTGCTTGCT
TCCAGACATAACCTGCATGAATCAGTTTTGGGGGAATGGACCTGGCATGGGGATGGGTTCAGGCCAGGTCTTTTG
ATGGCCAGGAGTAGATGACAGGGAGTTGCCTTGGGGAACCTTTGGTGTGCCAAGAGGAGGTGGGTAGATGGGAGT
GGGGCTCGGTCCCCCAGGCCCAGGGGACTCTCTCCACTCTTTCCTGGGCTCGGGGCATCTGCCTGGAGTTACCTT
CCATCATGGCTACCTGCTGTGGTTTGAATGTTTGAGTCCCAACAAAATTCATATCAAAACATAATCCCAACTGGG
TGCAGTGGCTCACGCCTGTAATCCCAGCACTTTGGGAGGCCGAGGCGGGCGGATCAATAGGTCAGGAAATCCAGA
CCGTCCTGGCTAACATGGTGAAACCCCGTCTCTACTAAAAAAAAAAATACAAAAAATTAGCCGGGCGTTGTGGCG
GGCACCTGGAGTCCCAGCTACTCCGGAGGCTGAGGGAGGAGAATGGTGTGAACCCGGGAGGTGGAGCTTCCAGTG
AGCCGAGATCGCGCCACTGCACTCCAGGCTGGGCGACAGAGCGAGACTCCGTCTCAAAAAAATAAATACATAAAT
AAAAAATAAACCACCCATAAAAAAAAAAAAAAAAAAAAAAAAAAAAAA
```

FIGURE 127

MAQAPADPGREGHLEQRILQVLTEAGSPVKLAQLVKECQAPKRELNQVLYRMKKELKVSLTSPATWCLGGTDPEG
EGPAELALSSPAERPQQHAATIPETPGPQFSQQREEDIYRFLKDNGPQRALVIAQALGMRTAKDVNRDLYRMKSR
HLLDMDEQSKAWTIYRPEDSGRRAKSASIIYQHNPINMICQNGPNSWISIANSEAIQIGHGNIITRQTVSREDGS
AGPRHLPSMAPGDSSTWGTLVDPWGPQDIHMERSILRRVQLGHSNEMRLHGVPSEGPAHIPPGSPPVSATAAGPE
ASFEARIPSPGTHPEGEAAQRIHMKSCFLEDATIGNSNKMSISPGVAGPGGVAGSGEGEPGEDAGRRPADTQSRS
HFPRDIGQPITPSHSKLTPKLETMTLGNRSHKAAEGSHYVDEASHEGSWWGGGI

FIGURE 128

```
GACCGCTGACCTAGAGGGAGTTATGCACATGGGCTTATAAGGTTAGCCAAGAGAAAGGACAAGAAGACCCAAAGT
CGGCAAGCAAATTTATTAACCTGCTGGGCTGCTCTACAGAAATCTGAGGAGGCAGACACCGGGCTTACAGGCTAA
GGGGTATAAGTAGGTCTGCAGGGGTTTTGTGTGTGTGTGCGGGGGTGTCGGGGGGGCAAGGCCATTTGTGGAGAC
TTTTCCTCCCAGTATGGCCACATCCTGCAGTTTGTCAGTTTTTGCCCCCGCCTGGCTCAGGGTACCAGGATGTGG
TTTAGCTTAGGGGTGGTTATAGTGGCACCTAAGTTCTGGGAACTTGCGGTGGGGGCGACCTTTTGGACGAAAAAT
AAGCTGCAGGGCAGCTAGGGGAGGGGGCTTGTTATATTCCTCTGGGGGCAGGGTGTCCCTAACTGGGCTCAGTCG
GAAGGAACTTGACCAAAGTCTGGGCTCAGTTGGGCATCACTCAGGCTAATGGTCGTGTGCTGGATGCCATCAGAG
GGAAGTACCAATGGTAAAGTGGAAACAATGTGCAGCTTTCAACTGGGTGGAGGCTGCTATTCTGTGGACAGTGAG
ATGTTTCCTTGGCACTGTCAATAGACAATCTGCGTAGAGAAATTCCAAGCTGAAAGCCAATAATGTTATAATAAA
ATAGAGATTCTTCAGAAGATGAAAGGAATTACCAGCATGGAAATTGTGTCATAGGCTTAAGGGCTAAAGAAGAAG
CCTTTTCTTTTCTGTTCACCCTCACCAAGAGCACAACTTAAATAGGGCATTTTATAACCTGAACACAATTTATAT
TGGACTTAATTATTATGTGTAATATGTTTATAATCCTTTAGATCTTATAAATATGTGGTATAAGGAATGCCATAT
AATGTGCCAAAAATCTGAGTGCATTTAATTTAATGCTTGCTTATAGTGCTAAAGTTAAATGATCTTAATTCTTTG
CAATTATATATGAAAAATGACTGATTTTTCTTAAAATATGTAACTTATATAAATATATCTGTTTGTACAGATTTT
AACCATAAAAACATTTTTGGAAAACCATAAA
```

TADLEGVMHMGL

```
GAGGCAGAAAGGCAGAAAGGAGAAAATTCAGGATAACTCTCCTGAGGGGTGAGCCAAGCCCTGCCATGTAGTGCA
CGCAGGACATCAACAAACACAGATAACAGGAAATGATCCATTCCCTGTGGTCACTTATTCTAAAGGCCCCAACCT
TCAAAGTTCAAGTAGTGATATGGATGACTCCACAGAAAGGGAGCAGTCACGCCTTACTTCTTGCCTTAAGAAAAG
AGAAGAAATGAAACTGAAGGAGTGTGTTTCCATCCTCCCACGGAAGGAAAGCCCCTCTGTCCGATCCTCCAAAGA
CGGAAAGCTGCTGGCTGCAACCTTGCTGCTGGCACTGCTGTCTTGCTGCCTCACGGTGGTGTCTTTCTACCAGGT
GGCCGCCCTGCAAGGGGACCTGGCCAGCCTCCGGGCAGAGCTGCAGGGCCACCACGCGGAGAAGCTGCCAGCAGG
AGCAGGAGCCCCCAAGGCCGGCCTGGAGGAAGCTCCAGCTGTCACCGCGGGACTGAAAATCTTTGAACCACCAGC
TCCAGGAGAAGGCAACTCCAGTCAGAACAGCAGAAATAAGCGTGCCGTTCAGGGTCCAGAAGAAACAGTCACTCA
AGACTGCTTGCAACTGATTGCAGACAGTGAAACACCAACTATACAAAAAGGATCTTACACATTTGTTCCATGGCT
TCTCAGCTTTAAAAGGGGAAGTGCCCTAGAAGAAAAAGAGAATAAAATATTGGTCAAAGAAACTGGTTACTTTTT
TATATATGGTCAGGTTTTATATACTGATAAGACCTACGCCATGGGACATCTAATTCAGAGGAAGAAGGTCCATGT
CTTTGGGGATGAATTGAGTCTGGTGACTTTGTTTCGATGTATTCAAAATATGCCTGAAACACTACCCAATAATTC
CTGCTATTCAGCTGGCATTGCAAAACTGGAAGAAGGAGATGAACTCCAACTTGCAATACCAAGAGAAAATGCACA
AATATCACTGGATGGAGATGTCACATTTTTTGGTGCATTGAAACTGCTGTGACCTACTTACACCATGTCTGTAGC
TATTTTCCTCCCTTTCTCTGTACCTCTAAGAAGAAAGAATCTAACTGAAAATACCAAAAAAAAAAAAAAA
```

FIGURE 131

MDDSTEREQSRLTSCLKKREEMKLKECVSILPRKESPSVRSSKDGKLLAATLLLALLSCCLTVVSFYQVAALQGD
LASLRAELQGHHAEKLPAGAGAPKAGLEEAPAVTAGLKIFEPPAPGEGNSSQNSRNKRAVQGPEETVTQDCLQLI
ADSETPTIQKGSYTFVPWLLSFKRGSALEEKENKILVKETGYFFIYGQVLYTDKTYAMGHLIQRKKVHVFGDELS
LVTLFRCIQNMPETLPNNSCYSAGIAKLEEGDELQLAIPRENAQISLDGDVTFFGALKLL

FIGURE 132

GGAGATGGAGACATGATTTCTCATGCAACAGCTTCTCTAATTATACCTTAGAAATGTTCTCCTTTTTATCATCAA
ATCTGCTCAAGAAGGGCTTTTTATAGTAGAATAATATCAGTGGATGAAAACAGCTTAACATTTTACCATGCTTAA
GTTTTAAGAATAAAATAAAAATTGGAAATAATTGGCCAAAATTGAAAGGAAAAATTTTTTTAAAATTTCTCTAAA
TGTAGGCCTGGCTGGGCTTTGACCTTTTCCGTTTTTAAATCACTCACAGAGGGTGGGACAGGAGGAAGAGTGAAG
GAAAAGGTCAAACCTGTTTTAAGGGCAACCTGCCTTTGTTCTGAATTGGTCTTAAGAACATTACCAGCTCCAGGT
TTAAATTGTTCAGTTTCATGCAGTTCCAATAGCTGATCATTGTTGAGATGAGGACAAAATCCTTTGTCCTCACTA
GTTTGCTTTACATTTTTGAAAAGTATTATTTTTGTCCAAGTGCTTATCAACTAAACCTTGTGTTAGGTAAGAATG
GAATTTATTAAGTGAATCAGTGTGACCCTTCTTGTCATAAGATTATCTTAAAGCTGAAGCCAAAATATGCTTCAA
AAGAAGAGGACTTTATTGTTCATTGTAGTTCATACATTCAAAGCATCTGAACTGTAGTTTCTATAGCAAGCCAAT
TACATCCATAAGTGGAGAAGGAAATAGATAAATGTCAAAGTATGATTGGTGGAGGGAGCAAGGTTGAAGATAATC
TGGGGTTGAAATTTTCTAGTTTTCATTCTGTACATTTTTAGTTAGACATCAGATTTGAAATATTAATGTTTACCT
TTCAATGTGTGGTATCAGCTGGACTCAGTAACACCCCTTTCTTCAGCTGGGGATGGGGAATGGATTATTGGAAAA
TGGAAAGAAGAAAGTAACTAAAAGCCTTCCTTTCACAGTTTCTGGCATCACTACCACTACTGATTAAACAAGAAT
AAGAGAACATTTTATCATCATCTGCTTTATTCACATAAATGAAGTTGTGATGAATAAATCTGCTTTTATGCAGAC
ACAAGGAATTAAGTGGCTTCGTCATTGTCCTTCTACCTCAAAGATAATTTATTCCAAAAGCTAAGATAAATGGAA
GACTCTTGAACTTGTGAACTGATGTGAAATGCAGAATCTCTTTTGAGTCTTTGCTGTTTGGAAGATTGAAAAATA
TTGTTCAGCATGGGTGACCACCAGAAAGTAATCTTAAGCCATCTAGATGTCACAATTGAAACAAACTGGGGAGTT
GGTTGCTATTGTAAAATAAAATATACTGTTTTGAAAACTTTGT

FIGURE 133

MGDHQKVILSHLDVTIETNWGVGCYCKIKYTVLKT

FIGURE 134

```
ATCGGAAAAGCACCTTGAGTTACTGGCTTCCCCTTTACCTATTCCATCAACCTTCCTTCCACACAGTAGTACTCC
CGCTTTGCATCTTACAGTTCAGAGGCTAAAGTTGCCACCACCACAGGGATCTTCTGAGAGCTGCACAGTTAACAT
CCCACAACAACCACCCGGAAGCCTGAGCATCGCATCACCAAACACTGCCTTTATTCCTATCCATAACCCAGGTAG
TTTCCCAGGCTCTCCTGTTGCTACCACGGACCCCATCACAAAATCTGCATCCCAAGTGGTAGGACTCAATCAAAT
GGTGCCTCAAATTGAGGGAAACACAGGGACAGTCCCTCAGCCTACCAATGTGAAGGTAGTTCTTCCAGCAGCTGG
CCTCTCAGCTGCTCAGCCACCAGCTTCCTACCCCTTACCAGGCTCTCCCCTTGCTGCCGGCGTGTTACCCAGCCA
GAACTCCAGTGTGCTCAGCACAGCAGCAACTTCTCCCCAGCCAGCGAGCGCAGGTATCAGCCAGGCCCAGGCAAC
TGTTCCTCCTGCAGTTCCTACCCACACCCCAGGCCCTGCCCCGAGCCCAAGCCCTGCCTTGACACACAGTACCGC
GCAGAGTGACAGCACCTCTTACATCAGTGCTGTGGGGAACACGAACGCTAATGGGACAGTAGTGCCACCGCAGCA
GATGGGCTCAGGTCCTTGTGGTTCTTGTGGGCGAAGGTGCAGCTGTGGGACCAATGGAAACCTTCAGCTAAATAG
TTACTATTATCCTAATCCAATGCCTGGACCAATGTACCGAGTCCCTTCATTCTTTACTCTGCCATCCATTTGCAA
TGGCAGCTACCTCAACCAAGCACATCAGAGCAATGGAAACCAACTTCCTTTTTTTCTGCCTCAGACTCCATATGC
AAATGGACTGGTACATGACCCAGTCATGGGGAGCCAAGCCAACTATGGCATGCAGCAGATGGCAGGATTTGGGAG
ATTCTATCCTGTATATCCAGCACCTAACGTAGTTGCCAACACCAGTGGTTCGGGGCCCAAGAAGAATGGGAATGT
CTCATGTTACAATTGTGGTGTAAGCGGACACTACGCACAGGACTGTAAGCAGTCGTCCATGGAGGCCAATCAACA
AGGCACTTACAGACTGAGATACGCACCTCCCCTCCCCCCTTCTAATGATACGTTGGATTCTGCAGACTGAAACGA
GTAAAGCTTGCCTACTTAATACACTCAAGTGTGGGGAGTCATGGGGTGTGGAGGGGAGGAAAGGAAAGGTATTTT
GTTTCTTTGTCTATACATTTCCTAGATTTCTATGCAGTTGGGATTTTTCATTTCTCTTGTACCAATGTCCAAAAC
AAGAAAGAATGCAATGCTTTTGAGCCTCTGGTCTCCTGGTTCAACAACAGGCTTATATGTATGATACATGTAATT
TAAACCTTCAGACAAACTTAAATGTTGGTGCGTGCTTTTTTTTTTTTTACACTGAATACTTGCTGTGTGCAATG
TTTACTGAATCTTTAAAACTGTGTATTTGACCTTTTTTTTACAACACTGGTGACAGTCATATGGTTTTGAAAAAA
AAAAGAAATTTTGCTTCTTCCCAGCTTTTCTCACTTTCACCCTAAACGACACTTCCTCCCCAGCCAGCCTCACTC
TGTCTCCGGCCCGCAGCAGGAGCAGCCAGCAGTGCATTCACCCCACTTTTGTAAACTGCTCTGCATATAAACCAA
GGGCAGAATGTTTCACCCTGATCTTATGGGAGGAATCGAACTCCCAAAATAGTGTGTATATATGTAATAAACAGC
GTCACGTAAATACATATATGCAGTGCTTGTTGTCCAAATAGAAATGAAAATAAGTGGAAGAGAGAGGAAGAAGTC
AACCATATGAAACTGAAAAAATATGACGTACGAAATGGACAAAAAGCTTTTTCTGAAACCAACTTTTTACTTCCA
TCATCCTTTTTTAGCCTGTTGCTTCAGAGAGACACAAAGTGAACACACTGGTGTGAATGTCGCTCTCTGTGTGCT
TGTGTTTGTAATGAAAGTCTACAGCCAATTTTACTTGTCTACCACCGTGTTGTGCTCAAAGAGACACTACTTGAG
TGAAGATTTCTTCTTTCCCTGTACCAGCTGTTACAGTGTTACGTTGTGTTTAAAATGTGTATGGTTTATTGCAAT
CTGAACAGAGCTATGGGTTTCTACCATAAGTCAGGTTGTTTGTTCCCTAACCTGTCTCTCGTAGCAAAGTCACTT
TTATAACAGTTTACCACTATGCTTGATTATAATGTGAAAGGCGGAATTCTGAGTGTGTTAAGATGGTATTAATCA
TGTCGGTGTCATGTCACTAAGTTTAATGCTGCTGTTTTAAAAAAAAAAAAAAGTTTTTTAAAAAGCCAATCTAT
GTACTAAATTGCTTCCAGGTAATTTTTGATTTCCTAAAGTGCACTGAGGTTATCTGGAAGATTGGGTGTATTTTT
TGGTGACTGCTGCATTCATCAGCAATGAACAGTTTCCACTGTATAGTCCTAGGGGTCAGGGGGTGGGGTTTCAT
TTTCCATTCCTCAGCACAGAGCAGAAATGATAGATTTTATTGTTTGGAGTAACGTTGGTATGCAGCAGAGGAAC
ATAAACATTTGGTCTTGGTTCAGAAGCCTAACAGATTGCTAGACAAGAGAAAAAACTTGAAGAAAAAGAAGCTT
AATTTCATGCTTCATAAGTAGCATTTATATTTATAGCACCAATGTACATTTTGAAACTTTCTTTCAGGGGTGGGA
GTTATGGGGAAGGGGTGGGTGTGAAGGGGTAGATGAAAGCTTTAATTTAGAAAGAAAGTTCAAGTAAAGGAAATT
ATTTTGATTAAATATATTTTATTTGATCTGGGTATTTTTGGACCACATTATTAAATTAATTGTTAAGCTGCAGTT
GAGTTGTTCAAGTGAGAGTTTTGATAAGCCACTTATGGGCCGCGTTGTGAATCACTTGCCAGTTGTACTTTATGG
AGCTTATTTTATGATTTAAAATACTGTACTGTACATAGGAGGTATGTTACCTTCTCCTTATTTGTATGTTTACCA
TATACTTTGATATTTGAAATGTTATGTACTGGAAAGGCCACTTATATTTCTAGAACAGATTGGATTTTATGCAAC
CTTTTTTCCTTGAATTAACAGCAATAAAAAAATGAAAACAAAAAAAAAAAAAAAAAAA
```

FIGURE 135

```
ATCTGAAAAATTAATAATTCCTTAATTATCAAATATCCATTATTTAAATTTATAATTGTGTCATAAATATTGTCA
TAAATAGATTTGCTGTTTTAAAGCTTGTTCCTTCATTTTCTCTGTTTTGTTTTAGATAAACATTGTCATAAATAG
ATTTGTTGTTTTAAAGCTTGTTCCTTCATTTTCTCTGATTGTTTTGTTTTAGATTCAGAGGTTACTTATGCTTGT
TTGTTACATGGATGTTACATGTGTAATGGGGGATATTGGACTTCTAGTGTACTCATCACCCATATACTGAACACT
GTACTCAAAAGGGATTGAAAGAAACTAGGAAACTTGGCAGGAAGATCATTCTTAAGCCAGGAAAAAAATTTTTAA
TGCTCACATGTGAACATGTGATGGTCATACCAGAAGGAGCACCCACCTCCCTCCCTCTGTGACAGACACATTTTC
TTAGCCTTCACCTTTCCTTCTTTCAAGTTGCTGAAAATCCACAGTGTTTCTGTTCATTTGTTACTTTCATTCTCA
CCTATCTTCTCTCTTGCTCCATCTACCAGAACAATAATTCCCCATATAATACTTCTCACTTCACTTTTCAACGCA
GGACCTCTTGTTGGTCTGATCTGTTTGTCTGTCCGCTTTATCAATATTATCAGATGTAAGTTTACATGAATACAC
ACACATATTCACTAAACTGAGGGGAAAAAATGCCTTGTAGGTCATAAAAAAGCAGGGAAATTCCCAACAATTCAT
ATTTGATCCCTGGATCCAGGGGTGGCAGCAATAAGCCTGCTTTAGATATTTACTCCCCATTTTATGATCCGGTGG
TTTGTTTTTCAAATGATGATATGGCTCCTTTCGCAATGACTTGATGTTTAGGAGGTGTGCTTCAATAAATACAT
TTTAAAATCAACAATCAAGTTAGAGTTGTACAAATGGCTCTGAAATGTCCCACTACACTGTTAGACCAAGGGCAC
AGATTGTGCTTCTGTACTATTTATCCTAGTATCCCTCGGCATATATTAACTGCTCTAAAAATCTCCTTGGCTACA
CGCTGCATCAAATCAAAGTTAAATGTTATACCACCTTTCTATTCTATTTTTAATATTCAAAGAGGGTGCTCAGAT
TTTAGAACAAATTTCAATGTTTAAGTACACACAAAAAAATCATTAACTCATATATTTCAAGAGTAGGAAATGGGA
ACTGGTGTTAAAACTCTTATAACAAATGTCACTGTCTTAAGGGACAGTGTTTAAAAACGCATACCTGGCCGGGCG
CGGTGGCTCATGCCTGTAATCCCAGCACTTTGGGAGGCCGAGGCCGGCGGATCACAAGGAAAACAAACTCAGGAA
GAAAAAGGAAAGCAGAAGTGATCAAGGAGAGCGCTCGAGTTGCAATATTTTCCTTTGGCTGCTGACAGGCAGTTA
CTATAAAGCATTGTGCATGGACACCATCTTCTTGTATTATACAAGAAAGGAGTGTACCTATCACACACAGGGGGA
AAAATGCTCTTTTGGGTGCTAGGCCTCCTAATCCTCTGTGGTTTCTGTGGACTCGTAAAGGAAAACTAAAGATT
GAAGACATCACTGATAAGTACATTTTTATCACTGGATGTGACTCGGGCTTTGGAAACTTGGCAGCCAGAACTTTT
GATAAAAAGGGATTTCATGTAATCGCTGCCTGTCTGACTGAATCAGGATCAACAGCTTTAAAGGCAGAAACCTCA
GAGAGACTTCGTACTGTGCTTCTGGATGTGACCGACCCAGAGAATGTCAAGAGGACTGCCCAGTGGGTGAAGAAC
CAAGTTGGGGAGAAAGGTCTCTGGGGTCTGATCAATAATGCTGGTGTTCCCGGCGTGCTGGCTCCCACTGACTGG
CTGACACTAGAGGACTACAGAGAACCTATTGAAGTGAACCTGTTTGGACTCATCAGTGTGACACTAAATATGCTT
CCTTTGGTCAAGAAAGCTCAAGGGAGAGTTATTAATGTCTCCAGTGTTGGAGGTCGCCTTGCAATCGTTGGAGGG
GGCTATACTCCATCCAAATATGCAGTGGAAGGTTTCAATGACAGCTTAAGACGGGACATGAAAGCTTTTGGTGTG
CACGTCTCATGCATTGAACCAGGATTGTTCAAAACAAACTTGGCAGATCCAGTAAAGGTAATTGAAAAAAAACTC
GCCATTTGGGAGCAGCTGTCTCCAGACATCAAACAACAATATGGAGAAGGTTACATTGAAAAAAGTCTAGACAAA
CTGAAAGGCAATAAATCCTATGTGAACATGGACCTCTCTCCGGTGGTAGAGTGCATGGACCACGCTCTAACAAGT
CTCTTCCCTAAGACTCATTATGCCGCTGGAAAAGATGCCAAAATTTTCTGGATACCTCTGTCTCACATGCCAGCA
GCTTTGCAAGACTTTTTATTGTTGAAACAGAAAGCAGAGCTGGCTAATCCCAAGGCAGTGTGACTCAGCTAACCA
CAAATGTCTCCTCCAGGCTATGAAATTGGCCGATTTCAAGAACACATCTCCTTTTCAACCCCATTCCTTATCTGC
TCCAACCTGGACTCATTTAGATCGTGCTTATTTGGATTGCAAAAGGGAGTCCCACCATCGCTGGTGGTATCCCAG
GGTCCCTGCTCAAGTTTTCTTTGAAAAGGAGGGCTGGAATGGTACATCACATAGGCAAGTCCTGCCCTGTATTTA
GGCTTTGCCTGCTTGGTGTGATGTAAGGGAAATTGAAAGACTTGCCCATTCAAAATGATCTTTACCGTGGCCTGC
CCCATGCTTATGGTCCCCAGCATTTACAGTAACTTGTGAATGTTAAGTATCATCTCTTATCTAAATATTAAAAGA
TAAGTCAAACATT
```

FIGURE 136

MLFWVLGLLILCGFLWTRKGKLKIEDITDKYIFITGCDSGFGNLAARTFDKKGFHVIAACLTESGSTALKAETSE
RLRTVLLDVTDPENVKRTAQWVKNQVGEKGLWGLINNAGVPGVLAPTDWLTLEDYREPIEVNLFGLISVTLNMLP
LVKKAQGRVINVSSVGGRLAIVGGGYTPSKYAVEGFNDSLRRDMKAFGVHVSCIEPGLFKTNLADPVKVIEKKLA
IWEQLSPDIKQQYGEGYIEKSLDKLKGNKSYVNMDLSPVVECMDHALTSLFPKTHYAAGKDAKIFWIPLSHMPAA
LQDFLLLKQKAELANPKAV

FIGURE 137

```
GAATTCGCACTGCTCTGAGAATTTGTGAGCAGCCCCTAACAGGCTGTTACTTCACTACAACTGACGATATGATCA
TCTTAATTTACTTATTTCTCTTGCTATGGGAAGACACTCAAGGATGGGGATTCAAGGATGGAATTTTTCATAACT
CCATATGGCTTGAACGAGCAGCCGGTGTGTACCACAGAGAAGCACGGTCTGGCAAATACAAGCTCACCTACGCAG
AAGCTAAGGCGGTGTGTGAATTTGAAGGCGGCCATCTCGCAACTTACAAGCAGCTAGAGGCAGCCAGAAAAATTG
GATTTCATGTCTGTGCTGCTGGATGGATGGCTAAGGGCAGAGTTGGATACCCCATTGTGAAGCCAGGGCCCAACT
GATGATTTGGAAAAACTGGCATTATTGATTATGGAATCCGTCTCAATAGGAGTGAAAGATGGGATGCCTATTGCT
ACAACCCACACGCAAAGGAGTGTGGTGGCGTCTTTACAGATCCAAAGCGAATTTTTAAATCTCCAGGCTTCCCAA
ATGAGTACGAAGATAACCAAATCTGCTACTGGCACATTAGACTCAAGTATGGTCAGCGTATTCACCTGAGTTTTT
TAGATTTTGACCTTGAAGATGACCCAGGTTGCTTGGCTGATTATGTTGAAATATATGACAGTTACGATGATGTCC
ATGGCTTTGTGGGAAGATACTGTGGAGATGAGCTTCCAGATGACATCATCAGTACAGGAAATGTCATGACCTTGA
AGTTCTAAGTGATGCTTCAGTGACAGCTGGAGGTTTCCAAATCAAATATGTTGCAATGGATCCTGTATCCAAAT
CCAGTCAAGGAAAAAATACAAGTACTACTTCTACTGGAAATAAAAACTTTTTAGCTGGAAGATTTAGCCACTTAT
AAAAAAAAAAAAGGATGATCAAAACACACAGTGTTTATGTTGGAATCTTTTGGAACTCCTTTGATCTCACTGTTA
TTATTAACATTTATTTATTATTTTTCTAAATGTGAAAGAAATACATAATTTAGGGAAAATTGGAAAATATAGGAA
ACTTTAAACGAGAAAATGAAACCTCTCATAATCCCACTGCATAGAAATAACAAGCGTTAACATTTTCATATTTTT
TTCTTTCAGTCATTTTTGTATTTGTGGTATATGTATATATGTACCTATATGTATTTGCATTTGAAATTTTGGAAT
CCTGCTCTATGTACAGTTTTGTATTATACTTTTTAAATCTTGAACTTTATGAACATTTCTGAAATCATTGATTA
TTCTACAAAAACATGATTTTAAACAGCTGTAAAATATTCTATGATATGAATGTTTATGCATTATTTAAGCCTGT
CTCTATTGTTGGAATTTCAGGTCATTTTCATAAATATTGTTGCAATAAATATCCTTCGGAATTC
```

FIGURE 138

MIILIYLFLLLWEDTQGWGFKDGIFHNSIWLERAAGVYHREARSGKYKLTYAEAKAVCEFEGGHLATYKQLEAAR
KIGFHVCAAGWMAKGRVGYPIVKPGPNCGFGKTGIIDYGIRLNRSERWDAYCYNPHAKECGGVFTDPKQIFKSPG
FPNEYEDNQICYWHIRLKYGQRIHLSFLDFDLEDDPGCLADYVEIYDSYDDVHGFVGRYCGDELPDDIISTGNVM
TLKFLSDASVTAGGFQIKYVAMDPVSKSSQGKNTSTTSTGNKNFLAGRFSHL

FIGURE 139A

```
TGCTCACTTCTGACAGCCAGACAAGGGCTGTGCTCAGGGGCAGCTCGGCTGGGCACACAGTAGGTGCTTTAGCGG
ACAGCACTGAGGCCCCCAGCAAGAAGCCCATGAGCTCCTCCCCCTCCCGCAGTGCCGCCGACATCTACATCCGGG
AGTATTTCCACAGCCACGTCAGCGGCGGCCACCCCGAGGCCACTCCTCTCCGTGTGATGTACACGGACCGGCCGC
TGAGCCAGACGGACCCAGTCACGCTGCAGTACTGTTGCCTGACCGACGACCGCCAGGCTTTCCGCCCGCCCACAC
GGGCAGAGCTGGCGCGGCACCGCGTGGTGGTCACCACCACCTCCCAGGCCCGTGAGCTCAGGGTGCCGGTCGGCT
TCTTCTCCCACATTCTCATCGATGAGGCGGCCCAGATGCTGGAGTGCGAGGCCCTCACCCCGCTGGCCTACGCCT
CGCACGGCACCCGCCTCGTGCTGGCGGGCGACCACATGCAGGTCACACCCCGGCTGTTCAGTGTGGCCAGGGCCC
GGGCGGCCGAGCACACGCTGCTGCACCGCCTCTTCCTGTGCTACCAGCAGGAGACTCACGAGGTGGCGCGGCAGA
GCCGCCTGGTCTTCCACGAGAACTACCGCTGCACGGACGCCATTGTCAGCTTCATCTCGCGGCACTTCTACGTGG
CCAAGGGCAACCCCATCCACGCCAGGGGCAAGGTTCCGCCCCACCCCGGCACTACCCGCTCATGTTCTGCCACG
TGGCGGGCAACCCAGACCGGGACATGTCCATGGCGTCCTGGCTGAATCTGGCTGAGATTGCGCAGGTCGTCGAGA
AGGTGCAGGAGGCCTACAACACCTGGCCCAGCTGCTGGGGCGGCCGTGAGCAGAGGTGCATCTGTGTCGTTTCCC
ACGGTGCCCAGGTCAGTGCACTGAGGCAGGAGCTGAGGAGGCGGGACCTAGGCCAGGTGTCTGTCGGCAGTTTTG
AGATCCTGCCAGGGCGGCAGTTCCGGGTCGTGGTGCTCAGCACTGTGCACACCTGCCAGAGCCTGCTCAGCCCTG
GGGCACTGGCCCCTGAGTTCTTCACCGACGCCCGCGTGCTCAACACCGTCCTGACCCGCGCCCAGTCCCAGCTGG
TGGTAGTGGGGGACGCCGTGGCCCTCTGCTCCTTCGGGGCCTGCGGCAAGCTCTGGGAGAGCTTCATCCGTGAGT
GCGTGGAGCGGCACAGTGTCTGCCCCGAGGGCCTGTCCATGGAGCAGGTCGAGCAGGGTGTGGCGCAGAGACGGC
GCTGGCCTCCCCGAGGCACACAGGCTGGGGCAGCGGGGAACTGGGAGGCTGCCCCAGAGCCAGTAGGGGACCTGG
CCGAGGAGCAGGCGGCTGTGGTGACGGCCATGGTGAAGGCAGAGCCGGGAGATGAGGCTCTGAGCCCAGCATCCC
GTGACATCACGGCAACCACAGCGCAGACGGAGGCTGCGGCAGCACCAGCAGGAGACGCAGTGAAGGAAGACGTGG
TGCCCGGGGCCTGTGCGGCAGGAGCGGCTGCTGCAGCGGGCGTGGAGTCCACGGAGGCTGAGGATGCAGAGGCTG
ACTTCTGGCCGTGGGACGGGGAGCTCAACGCTGACGACGCCATCCTACGGGAGCTTCTGGACGAGAGCCAGAAGG
TGATGGTGACCGTCGGGGAGGACGGGCTGCTGGACACCGTCGCCAGGCCCGAGTCCCTGCAGCAGGCCCGGCTGT
ACGAGAACCTGCCCCCGGCTGCGCTACGGAAGCTGCTGCGCGCGGAGCCCGAGCGGTACCGCCACTGCTCTTTCG
TGCCAGAGACCTTCGAGCGGGCGTCAGCCATCCCGCTGGACGATGCCTCCTCGGGCCCCATCCAGGTCAGGGGCC
GCCTGGACTGTGGGATGGCCTTCGCCGGGGATGAGGTGCTGGTGCAGCTCCTTTCGGGAGACAAGGCGCCCGAGG
GGCGGCTTCGGGGCCGCGTGCTGGGCGTGCTGAAGAGGAAGAGGCACGAGCTGGCGTTTGTGTGCCGCATGGACA
CGTGGGACCCGCGCATCATGGTCCCCATCAATGGCTCCGTGACCAAGATCTTCGTGGCCGAGCTGAAGGACCCAT
CGCAGGTCCCCATCTACAGCCTCCGGAAGGGCCGGCTGCAGCGTGTGGGGCTTGAGAGGCTCACCGCCGAGGCCC
GGCACAGCCGGCTCTTCTGGGTCCAAATTGTCCTGTGGCGGCAAGGCTTCTACTACCCGCTGGGCATCGTCCGGG
AGGTGCTGCCTGAGGCCAGCACCTGGGAGCAGGGCCTCCGCATCCTCGGCCTGGAGTACAGCTTGAGGGTGCCCC
CGTCGGACCAGGCCACCATCACCAAGGTGCTGCAGAAATACCACACGGAGCTTGGCCGGGTTGCCGGCCGCCGAG
AGGACTGCCGCGCCTTCTTGACCTTCACTGTGGACCCCCAGGGCGCCTGCAACCTCGATGATGCCCTCAGTGTCC
GAGACCTGGGTCCCAGGTGCGAGGTGGCTGTGCACATCACTGATGTGGCCAGCTTCGTGCCCAGGGACGGGGTGC
TGGACGTGGAGGCGCGAAGGCAGGGCGCTGCGTTCTATGCCCCCGGCAGGGAGCCAGTGCCCATGCTGCCGGCCA
GCCCTCTGCCAGGACGTCCTCAGCCTCCTGCCTGGCCGGGACCGCCTGGCCATCTCCCTGTTCCTCACCATGGAGA
AGGCCAGTGGCCAGCTGAAGAGCCTGCGCTTTGCACCCTCCGTGGTCCAGTCTGACCGCCAGCTGTCCTACGAGG
AGGCGGAGGAGGTGATCAGGCAGCACCCGGGTGCCGGCCGTGAGCTGCCGGCCCGCCTGGACTCCGTGGACGCCT
GCGTCGTGGCCGCGTGCTACTTCTCTCGGCTGCTGCGCCGGCACCGCCTGCGGTCCGACTGCTTCTATGAGCAGC
CGGACGAGGACGGCACCCTGGGCTTCCGCGCGGCCCACATCATGGTGAAGGAGTACATGATTCAGTTTAATAGGC
TCGTGGCTGAGTTCCTGGTGGGCAGCGAGTGCACGCGGACGGTCACGCCTCTGCGGTGGCAGCCAGCACCCCGCA
GCCAGCAGCTCAAGGCCCTGTGTGAGAAGCATGGGGACCGGGTGCCCCTGTCACTGCACCTCGGCCACCACCTGC
ACGGCGGCGGGGCAGTCCCCCCGACACGCGGCTGCACCTCCTGGCCTCCCTCTGGAAGCAGGTCCAGTTTGCTG
CCCGCACCCAGGACTACGAACAGATGGTGGACTTGGTCACCACGGACGACATGCACCCATTCCTGGCTCCTGCAG
GCCGCGACCTCCGCAAGGCCCTGGAGCGCTCGGCGTTCGGCCGCTGCGCCCGGGGCCACCAGCAGCAGGGCGGCC
ACTACTCGCTGCAGGTGGACTGGTACACGTGGGCCACCTCGCCCATCCGCAGGTACCTGGACGTGGTGTTGCAGC
GGCAGATCCTGCTGGCGCTGGGCCATGGGGGCTCTGCCTACTCTGCCAGGGACATCGATGGGCTCTGCCAGGCCT
TCAGCCTCCAGCACGCACTTGCCCAGAGCTATCAGCGGCGGGCGCGCAGCCTGCACCTGGCCGTGCAGCTCAAGG
```

FIGURE 139B

```
CCCAGCCTCTGGACAAGCTGGGCTTCGTGGTGGACGTGGAGGCGGGCTCCCGCTGCTTCCGGCTGCTCTTCCCCA
GCAACCGGGAGACGCTGCCTGACCCCTGCCCCGTCCCTACGGCTCCCTGCAGCTGGCCGAGCACCCCACGCCC
TGGCAGGCCGGCCGGGCCTGCGGCTCCTGTGGCGGCGCCGTGTCTACTCAGCGCAGGGATCCAGCCCGCCCCTGC
CACTGCCTGGCACTGTGCCGGACCCACACACCCTGGCCGTGGAGACGGCCCTGTGGAAGCAGCTGCTGGAGCTGG
TGGAGCTGCAGCGCTGGCCGGAGGCGGCTGCTCTCATCCAGGAGAAGGGCGAGGCGTCCCAGCGGCGGGAGCTGG
TGCAGGTGCAGCGGAGCCACTGTGGCCATTTCCTGGAGGTGGCCCGGGAGCTGGGCAGTGGGGACACCCTGCAGG
TGCAGCTCGGCACCAGCCTGCAGCACGGCTTCCTGGTACCGAGCCCTCAGCTCTGGACGGTGGCACCGGGCTTCA
GCCTCTGCCTGGAGCACGTGGAGCGGCCCGGAGACTGCTTCTCAGGCCGTGTGTACCGGGCCCCGAGGGACCGGT
ACCGCGACGTGGATGAGTACGCCTGCGTGTGGGAACCATTCTGCGCCCTGGAGTCGGCCACCGGCGCGGTTGCCG
AGAATGACTCCGTCACACTTCAGCACCTGAGTGTCTCCTGGGAGGCGTCACGGACGCCGCAGGGGCAGCTGCAGG
GCGCCTTCCGCCTGGAGGCCGCCTTCCTCGAGGAGAACTGTGCCGACATCAACTTCAGCTGCTGCTACCTCTGCA
TCCGGCTCGAGGGGCTGCTGGCTCCCACGGCCAGCCCACGCCCCGGGCCCAGCAGCCTCGGCCCTGGCCTGAATG
TTGACCCCGGCACGTATACCTGGGTGGCCCACGGGCAGACGGAGGACTGGGACCAGGAGCGCCGGGCAGACCGGC
AGGAGGCTCCCAGACGGGTGCACCTCTTCGTCCACCACATGGGCATGGAGAAGGTTCCGGAAGAGGTGCTGAGGC
CGGGCACCCTGTTCACCGTTGAGCTGCTGCCCAAGCAGCTTCCTGATCTCCGCAAGGAGGAAGCCGTGCGTGGAC
TAGAGGAGGCGTCCCCGCTGGTCACCAGCATCGCACTGGGCCGGCCTGTCCCGCAGCCCCTCTGCAGAGTGATCC
CCAGCAGGTTCCTGGAGCGGCAGACCTACAACATCCCCGGAGGCCGCCACAAGCTGAACCCCAGCCAGAACGTGG
CGGTCAGGGAGGCTCTGGAGAAGCCTTTCACGGTCATTCAGGGCCCACCAGGTACAGGGAAGACGATCGTGGGCC
TCCACATCGTATTCTGGTTTCATAAATCAAACCAGGAGCAGGTGCAGCCCGGAGGCCCCCCCCGTGGGGAGAAGC
GGCTGGGGGGTCCCTGCATCTTGTACTGCGGCCCCTCCAACAAGTCGGTGGATGTCCTGGCAGGACTGCTCCTGA
GAAGGATGGAGCTGAAGCCCCTCCGTGTGTACAGTGAGCAGGCTGAGGCCAGCGAGTTCCCAGTGCCGCGTGTGG
GCAGCAGGAAGCTGCTCAGGAAGAGCCCCGGGAGGGGAGGCCGAACCAGAGCCTCAGGAGCATCACCCTGCACC
ACCGGATCCGGCAGGCCCCCAACCCTTACTCGTCGGAAATCAAGGCCTTTGACACCCGGCTGCAGAGAGGGGAGC
TCTTCTCCAGGGAGGACCTGGTCTGGTACAAGAAGGTCTTGTGGGAGGCTCGGAAGTTCGAGCTGGACCGGCATG
AGGTCATCCTCTGCACCTGCTCCTGTGCAGCCTCTGCCAGCCTCAAAATCCTGGACGTGAGGCAGATCCTTGTTG
ACGAGGCAGGCATGGCCACGGAACCTGAAACCCTCATCCCCCTGGTGCAGTTCCCACAGGCCGAGAAGGTGGTTC
TTCTCGGAGACCACAAGCAGCTGCGGCCTGTGGTCAAGAATGAGCGGCTGCAAAACCTGGGTCTGGACCGGTCTC
TGTTCGAGCGGTACCACGAGGACGCACATATGCTGGACACTCAGTACCGCATGCATGAGGGCATCTGTGCCTTCC
CCTCTGTGGCGTTCTACAAGAGCAAGCTGAAGACGTGGCAGGGCCTGAGGAGGCCGCCCAGTGTCCTGGGCCACG
CTGGCAAGGAGAGCTGTCCTGTCATCTTTGGCCACGTGCAGGGCCACGAGCGGAGCCTGCTGGTGTCCACGGACG
AAGGGAATGAGAACTCCAAGGCCAACCTGGAGGAGGTGGCTGAGGTGGTCCGTATCACCAAGCAGCTGACCCTGG
GGAGGACCGTAGAGCCCCAGGACATCGCCGTCCTCACGCCCTACAACGCGCAGGCCTCTGAGATCAGCAAGGCCC
TTCGGCGAGAGGGCATCGCCGGGGTGGCCGTGTCCTCCATCACCAAGAGCCAGGGGAGCGAGTGGCGCTATGTGC
TGGTGAGCACCGTCCGCACCTGTGCCAAGAGCGACCTGGACCAGCGGCCCACCAAGAGCTGGCTCAAGAAGTTTC
TGGGCTTCGTTGTGGACCCCAACCAAGTGAACGTGGCTGTCACGCGGGCCCAGGAGGGGCTCTGCCTGATCGGAG
ACCACCTCCTTCTGCGCTGCTGCCCCCTCTGGCGTAGCCTCCTGGACTTCTGCGAGGCTCAGCAGACCCTCGTGC
CTGCCGGCCAGGTGCGCGTCTGCAGGAGGCCAACTATGCCTTCCTGAAGAGCCCTCTCCACCTGCAAGGTGCCAG
GACTGGGAGGGAAAGTCCAGGGCCCCCCCACCCTCCCCACCACCCTCCGCCATCAGCCTGCCTGGGCCAGCCTGC
CTCCTGGCCTCAGGATCTCCCTGGGGCAGGAAGTGGGTGGACTTGGAGGAGGAACGGCAAGGGCCGGTCCCCACA
CTCTTGCTTCTCCTGGGCATCTGGGGACAGGAACACCTCTCAGGGTGGCCAAGAGGGGCTTCCTTGGGACCAGTG
TAAGGAAGTTCTGCTGTCCCTGGGAAGTCTCAGAACCAGGAAGGAAACCCTGTGGAGGCTGCCCTTTGACCTTTG
GACGCCACCTGTAATCACTCTGGATGGTGTCTGTGGAGTTCAGGTTTATTTTCTATTTAAATGAACTAAAAGCCA
GCATCCTGCCGGGCGTGGTGGCTCACGCCCATAATCCAGCACTTTGGGAAGCCGAGGCGGGCAGATCACCTGAGG
TCAGGAGTTCGAGACCATCCTGGCCAACATGGTGAAACCCCGTCTCCACTAAAAATACAAAATTAGCTGGGCGTG
GTGGCGGGCGCCTGTAATCCCAGCTACTTGGGAGGCTGAGGCAGGAGAATCGCTTGACTCCAGGAGGCGCAGGCT
GCAGTGAGCTCTGATGGTACCACTGCACTCCAGCCTGGGTGACAGAGCGAGACCCTGTCTTAAAAAAAAAAAAAC
AAAACAAAACCAGCATCTGTTACTGGAACAGAGACCTCAGCCCAAGCTCAGGACAAGGAGGCCTCCCTGGGAGAG
GGGGCCTTTCTCCCACCATCACCGCCTGTGTCCTTCAGGGGCTGCTGGAGGGCAGCCCAAAGCCAGGGGCCCACC
```

FIGURE 139C

```
CCGCCCCACCCCACCCCACCCCACCCTCTGAAATGTGAAAAGCCTGCACTCTTCCTGTGGGCTGCGCAGTGGGCT
CGGGGGTTGGGGGGTGCCGGGGCGATGCTTCCACCCTGGACTGAGTGTTCGGGGCAGCCTGCTCGGCTGTATGTT
TCTCGCACGCTCACCCGCTTCAGTGCGGCTCTGTCCCTGCTGCCGCCTCCAGTCCTGAGGGAGGGGCTTGCCCCA
CCTTCTACATTCCAATTTTTATATCTTTGAATTATGTGATTAGATATTAATTTAATGAT
```

FIGURE 140

```
AGCGGGGCAGAAGAGGAAGATTTCTGAAGAGTGCAGCTGCCTGAACCGAGCCCTGCCGAACAGCTGAGAATTGCA
CTGCAACCATGAGTGAGAACAATAAGAATTCCTTGGAGAGCAGCCTACGGCAACTAAAATGCCATTTCACCTGGA
ACTTGATGGAGGGAGAAAACTCCTTGGATGATTTTGAAGACAAAGTATTTTACCGGACTGAGTTTCAGAATCGTG
AATTCAAAGCCACAATGTGCAACCTACTGGCCTATCTAAAGCACCTCAAAGGGCAAAACGAGGCAGCCCTGGAAT
GCTTACGTAAAGCTGAAGAGTTAATCCAGCAAGAGCATGCTGACCAGGCAGAAATCAGAAGTCTGGTCACCTGGG
GAAACTATGCCTGGGTCTACTATCACATGGGCCGACTCTCAGACGTTCAGATTTATGTAGACAAGGTGAGACATG
TCTGTGAGAAGTTTTCCAGTCCCTATAGAATTGAGAGTCCAGAGCTTGACTGTGAGGAAGGGTGGACACGGTTAA
AGTGTGGAGGAAACCAAAATGAAAGAGCGAAGGTGTGCTTTGAGAAGGCTCTGGAAAAGAAGCCAAAGAACCCAG
AATTCACCTCTGGACTGGCAATAGCAAGCTACCGTCTGGACAACTGGCCACCATCTCAGAACGCCATTGACCCTC
TGAGGCAAGCCATTCGGCTGAATCCTGACAACCAGTACCTTAAAGTCCTCCTGGCTCTGAAGCTTCATAAGATGC
GTGAAGAAGGTGAAGAGGAAGGTGAAGGAGAGAAGTTAGTTGAAGAAGCCTTGGAGAAAGCCCCAGGTGTAACAG
ATGTACTTCGCAGTGCAGCCAAGTTTTATCGAAGAAAAGATGAGCCAGACAAAGCGATTGAACTGCTTAAAAAGG
CTTTAGAATACATACCAAACAATGCCTACCTGCATTGCCAAATTGGGTGCTGCTATAGGGCAAAAGTCTTCCAAG
TAATGAATCTAAGAGAGAATGGAATGTATGGGAAAAGAAAGTTACTGGAACTAATAGGACACGCTGTGGCTCATC
TGAAGAAAGCTGATGAGGCCAATGATAATCTCTTCCGTGTCTGTTCCATTCTTGCCAGCCTCCATGCTCTAGCAG
ATCAGTATGAAGAAGCAGAGTATTACTTCCAAAAGGAATTCAGTAAAGAGCTTACTCCTGTAGCGAAACAACTGC
TCCATCTGCGGTATGGCAACTTTCAGCTGTACCAAATGAAGTGTGAAGACAAGGCCATCCACCACTTTATAGAGG
GTGTAAAAATAAACCAGAAATCAAGGGAGAAAGAAAAGATGAAAGACAAACTGCAAAAAATTGCCAAAATGCGAC
TTTCTAAAAATGGAGCAGATTCTGAGGCTTTGCATGTCTTGGCATTCCTTCAGGAGCTGAATGAAAAAATGCAAC
AAGCAGATGAAGACTCTGAGAGGGGTTTGGAGTCTGGAAGCCTCATCCCTTCAGCATCAAGCTGGAATGGGGAAT
GGAGAATAGAGATGTGGTGCCCACTAGGCTACTGCTGATAGGGAGCTGAAATTCCTCCACCAAGTTGGTATTCAA
AATATGTAATGACTGGTATGGCAAAAGATTGGACTAAGACACTGGCCATACCACTGGACAGGGTTATGTTAACAC
CTGAATTGCTGGGTCTTGAGAGAGCCCAAGGAGTTCTGGGAGAGGGACCAGATTGGGGGGTAGGTCCACGGGCTT
GGTGATAGAATTATTTCTCGATTGACTTCTTGAGTGCAATTTGAACTGTAACATTTGCTTAGTCACCTTTAGTGG
AGTAATCCACTGGGCTTGTTTCTATATTTATATAAAGCAGCCAAATCCTTCATGTAATATTGAAGTCCATTTTTG
CAATGTTGTTCCATACTTGGAGTCATTTTGCATCCCATAGAGGTTAGTCCTGCATAGCCAGTAATGTGCTAAGTT
CATCCAAAAGCTGGGGGACCAAAGTCTAAATAGGGCTCAGTATCCCCCATCGCTTATCTCTGCCTCCTTCCTCCT
CCTTCCCAGTCTATCATCAACCTTGAGTATTCTACACAATGTGAATTCAAGTGCCTGATTAATTGAGGTGGCAAC
ATAGTTTGAGACGAGGGCAGAGAACAGGAAGATACATAGCTAGAAGCGACGGGTACAAAAAGCAATGTGTACAAG
AAGACTTTCAGCAAGTATACAGAGAGTTCACCTCTACTCTGCCCTCCTCATAGTCATAATGTAGCAAGTAAAGAA
TGAGAATGGATTCTGTACAATACACTAGAAACCAACATAATGTATTTCTTTAAAACCTGTGTGAAAAAATAAATG
TTCCACCAGTAGGGATAGGGGAAAAGTAACCAAAAGAGAGAAAGAGAAAGGAATGCTGGTTTATCTTTGTAGATT
GTAATCGAATGGAGAAATTTGCAGTATTTTAGCCACTATTAGGAATTTTTTTTTTGTAAAATGAAGACTGAAC
TCTGTTCAAATGCTTTCATGAACCTGGTTTGAGACGGTAGGAAAGCAACAAAACGTGGGAACCTGGTGACTAAGG
GCCTGGTGCAAGGACTTGGGAAATGTCATTAATAATAGATGGTGGGTTTTCCCCCCTTTAGAAATGTTGGATAT
TAAGTGATATAAACACTTCTTTTAACTCCGAAAATCTTCTGAGAAATCACAAAATTCACGGTATGCTTGGAACGA
TTGAGATTTTCTAGGTAGATGCTGAATAGCCTAGACATCAAAGTTGGTGTGAACCAAAATAGAGTCAGCTGACCC
AGCATCAGCCACACTCTGGGTTGGAAAATGTTTGCCTGTTGGAATTAATTTAAGCTTAAGTATATATCAACATTA
TTTTATTGTGCAATTAAAACAATACAAATTCATGGTTTTTAAAGTTAAAAATTCTAACCACTGTAACAACAGTT
TTTGTGTTATTTTCTGTATTAAACATCTTGTTGCACGCATTTGAGGTCATCAGGGTGCAAAATTTGTATTCCTGA
AAATGTCATATATTTTCATTAATAAATAACCTAAATATGATAAAACATAAAAAAAAAAAAAAAA
```

FIGURE 141

MEGENSLDDFEDKVFYRTEFQNREFKATMCNLLAYLKHLKGQNEAALECLRKAEELIQQEHADQAEIRSLVTWGN
YAWVYYHMGRLSDVQIYVDKVRHVCEKFSSPYRIESPELDCEEGWTRLKCGGNQNERAKVCFEKALEKKPKNPEF
TSGLAIASYRLDNWPPSQNAIDPLRQAIRLNPDNQYLKVLLALKLHKMREEGEEEGEGEKLVEEALEKAPGVTDV
LRSAAKFYRRKDEPDKAIELLKKALEYIPNNAYLHCQIGCCYRAKVFQVMNLRENGMYGKRKLLELIGHAVAHLK
KADEANDNLFRVCSILASLHALADQYEEAEYYFQKEFSKELTPVAKQLLHLRYGNFQLYQMKCEDKAIHHFIEGV
KINQKSREKEKMKDKLQKIAKMRLSKNGADSEALHVLAFLQELNEKMQQADEDSERGLESGSLIPSASSWNGEWR
IEMWCPLGYC

FIGURE 142

```
GGCACGAGGGTGTGCGTGATGGAGAAAATTGGGCACCAGGGCTGCTCCCGAGATTCTCAGATCTGATTTCCACGC
TTGCTACCAAAATAGTCTGGGCAGGCCACTTTTGGAAGTAGGCGTTATCTAGTGAGCAGGCGGCCGCTTTCGATT
TCGCTTTCCCCTAAATGGCTGAGCTTCTCGCCAGCGCAGGATCAGCCTGTTCCTGGGACTTTCCGAGAGCCCCGC
CCTCGTTCCCTCCCCCAGCCGCCAGTAGGGGAGGACTCGGCGGTACCCGGAGCTTCAGGCCCCACCGGGGCGCGG
AGAGTCCCAGACCCGGCCGGGACCGGGACGGCGTCCGAGTGCCAATGGCTAGCTCTAGGTGTCCCGCTCCCCGCG
GGTGCCGCTGCCTCCCCGGAGCTTCTCTCGCATGGCTGGGGACAGTACTGCTACTTCTCGCCGACTGGGTGCTGC
TCCGGACCGCGCTGCCCCGCATATTCTCCCTGCTGGTGCCCACCGCGCTGCCACTGCTCCGGGTCTGGGCGGTGG
GCCTGAGCCGCTGGGCCGTGCTCTGGCTGGGGGCCTGCGGGGTCCTCAGGGCAACGGTTGGCTCCAAGAGCGAAA
ACGCAGGTGCCCAGGGCTGGCTGGCTGCTTTGAAGCCATTAGCTGCGGCACTGGGCTTGGCCCTGCCGGGACTTG
CCTTGTTCCGAGAGCTGATCTCATGGGGAGCCCCCGGGTCCGCGGATAGCACCAGGCTACTGCACTGGGGAAGTC
ACCCTACCGCCTTCGTTGTCAGTTATGCAGCGGCACTGCCCGCAGCAGCCCTGTGGCACAAACTCGGGAGCCTCT
GGGTGCCCGGCGGTCAGGGCGGCTCTGGAAACCCTGTGCGTCGGCTTCTAGGCTGCCTGGGCTCGGAGACGCGCC
GCCTCTCGCTGTTCCTGGTCCTGGTGGTCCTCTCCTCTCTTGGGGAGATGGCCATTCCATTCTTTACGGGCCGCC
TCACTGACTGGATTCTACAAGATGGCTCAGCCGATACCTTCACTCGAAACTTAACTCTCATGTCCATTCTCACCA
TAGCCAGTGCAGTGCTGGAGTTCGTGGGTGACGGGATCTATAACAACACCATGGGCCACGTGCACAGCCACTTGC
AGGGAGAGGTGTTTGGGGCTGTCCTGCGCCAGGAGACGGAGTTTTTCCAACAGAACCAGACAGGTAACATCATGT
CTCGGGTAACAGAGGACACGTCCACCCTGAGTGATTCTCTGAGTGAGAATCTGAGCTTATTTCTGTGGTACCTGG
TGCGAGGCCTATGTCTCTTGGGGATCATGCTCTGGGGATCAGTGTCCCTCACCATGGTCACCCTGATCACCCTGC
CTCTGCTTTTCCTTCTGCCCAAGAAGGTGGGAAAATGGTACCAGTTGCTGGAAGTGCAGGTGCGGGAATCTCTGG
CAAAGTCCAGCCAGGTGGCCATTGAGGCTCTGTCGGCCATGCCTACAGTTCGAAGCTTTGCCAACGAGGAGGGCG
AAGCCCAGAAGTTTAGGGAAAAGCTGCAAGAAATAAAGACACTCAACCAGAAGGAGGCTGTGGCCTATGCAGTCA
ACTCCTGGACCACTAGTATTTCAGGTATGCTGCTGAAAGTGGGAATCCTCTACATTGGTGGGCAGCTGGTGACCA
GTGGGGCTGTAAGCAGTGGGAACCTTGTCACATTTGTTCTCTACCAGATGCAGTTCACCCAGGCTGTGGAGGTAC
TGCTCTCCATCTACCCCAGAGTACAGAAGGCTGTGGGCTCCTCAGAGAAAATATTTGAGTACCTGGACCGCACCC
CTCGCTGCCCACCCAGTGGTCTGTTGACTCCCTTACACTTGGAGGGCCTTGTCCAGTTCCAAGATGTCTCCTTTG
CCTACCCAAACCGCCCAGATGTCTTAGTGCTACAGGGGCTGACATTCACCCTACGCCCTGGCGAGGTGACGGCGC
TGGTGGGACCCAATGGGTCTGGGAAGAGCACAGTGGCTGCCCTGCTGCAGAATCTGTACCAGCCCACCGGGGGAC
AGCTGCTGTTGGATGGGAAGCCCCTTCCCCAATATGAGCACCGCTACCTGCACAGGCAGGTGGCTGCAGTGGGAC
AAGAGCCACAGGTATTTGGAAGAAGTCTTCAAGAAAATATTGCCTATGGCCTGACCCAGAAGCCAACTATGGAGG
AAATCACAGCTGCTGCAGTAAAGTCTGGGGCCCATAGTTTCATCTCTGGACTCCCTCAGGGCTATGACACAGAGG
TAGACGAGGCTGGGAGCCAGCTGTCAGGGGGTCAGCGACAGGCAGTGGCGTTGGCCCGAGCATTGATCCGGAAAC
CGTGTGTACTTATCCTGGATGATGCCACCAGTGCCCTGGATGCAAACAGCCAGTTACAGGTGGAGCAGCTCCTGT
ACGAAAGCCCTGAGCGGTACTCCCGCTCAGTGCTTCTCATCACCCAGCACCTCAGCCTGGTGGAGCAGGCTGACC
ACATCCTCTTTCTGGAAGGAGGCGCTATCCGGGAGGGGGAACCCACCAGCAGCTCATGGAGAAAAGGGGTGCT
ACTGGGCCATGGTGCAGGCTCCTGCAGATGCTCCAGAATGAAAGCCTTCTCAGACCTGCGCACTCCATCTCCCTC
CCTTTTCTTCTCTCTGTGGTGGAGAACCACAGCTGCAGAGTAGCAGCTGCCTCCAGGATGAGTTACTTGAAATTT
GCCTTGAGTGTGTTACCTCCTTTCCAAGCTCCTCGTGATAATGCAGACTTCCTGGAGTACAAACACAGGATTTGT
AATTCCTACTGTAACGGAGTTTAGAGCCAGGGCTGATGCTTTGGTGTGGCCAGCACTCTGAAACTGAGAAATGTT
CAGAATGTACGGAAAGATGATCAGCTATTTTCAACATAACTGAAGGCATATGCTGGCCCATAAACACCCTGTAGG
TTCTTGATATTTATAATAAAATTGGTGTTTTGT
```

FIGURE 143

MAELLASAGSACSWDFPRAPPSFPPPAASRGGLGGTRSFRPHRGAESPRPGRDRDGVRVPMASSRCPAPRGCRCL
PGASLAWLGTVLLLLADWVLLRTALPRIFSLLVPTALPLLRVWAVGLSRWAVLWLGACGVLRATVGSKSENAGAQ
GWLAALKPLAAALGLALPGLALFRELISWGAPGSADSTRLLHWGSHPTAFVVSYAAALPAAALWHKLGSLWVPGG
QGGSGNPVRRLLGCLGSETRRLSLFLVLVVLSSLGEMAIPFFTGRLTDWILQDGSADTFTRNLTIMSILTIASAV
LEFVGDGIYNNTMGHVHSHLQGEVFGAVLRQETEFFQQNQTGNIMSRVTEDTSTLSDSLSENLSLFLWYLVRGLC
LLGIMLWGSVSLTMVTLITLPLLFLLPKKVGKWYQLLEVQVRESLAKSSQVAIEALSAMPTVRSFANEEGEAQKF
REKLQEIKTLNQKEAVAYAVNSWTTSISGMLLKVGILYIGGQLVTSGAVSSGNLVTFVLYQMQFTQAVEVLLSIY
PRVQKAVGSSEKIFEYLDRTPRCPPSGLLTPLHLEGLVQFQDVSFAYPNRPDVLVLQGLTFTLRPGEVTALVGPN
GSGKSTVAALLQNLYQPTGGQLLLDGKPLPQYEHRYLHRQVAAVGQEPQVFGRSLQENIAYGLTQKPTMEEITAA
AVKSGAHSFISGLPQGYDTEVDEAGSQLSGGQRQAVALARALIRKPCVLILDDATSALDANSQLQVEQLLYESPE
RYSRSVLLITQHLSLVEQADHILFLEGGAIREGGTHQQLMEKKGCYWAMVQAPADAPE

FIGURE 144

```
TTATGCTAACATGAAGAAAAGAGAAGGGACTCAGCTTTCTTCCCAACAGTCTGTGATGTCTAAACTTGCATCATT
TTTGGGCTTTTCAAAGCAATCTCCCCAAAAAAAGAATCATTTGGTTTTGGAAAAGAAAACAGAATCAGCAACTTT
TCGGGTGTGTGGTGAAAATGTCACGTGTGTGGAATATGCTATCTCCTGGCTACAAGACCTGATTGAAAAAGAACA
GTGTCCTTACACCAGTGAAGATGAGTGCATCAAAGACTTTGATGAAAAGGAGTATCAGGAGTTGAATGAGCTGCA
GAAGAAGTTAAATATTAACATTTCCCTGGACCATAAGAGACCTTTGATTAAGGTTTTGGGAATTAGCAGAGATGT
GATGCAGGCTAGAGATGAAATTGAGGCGATGATCAAGAGAGTTCGATTGGCCAAAGAACAGGAATCCCGGGCAGA
TTGTATCAGTGAGTTTATAGAATGGCAGTATAATGACAATAACACTTCTCATTGTTTTAACAAAATGACCAATCT
GAAATTAGAGGATGCAAGGAGAGAAAAGAAAAAAACAGTTGATGTCAAAATTAATCATCGGCACTACACAGTGAA
CTTGAACACATACACTGCCACAGACACAAAGGGCCACAGTTTATCTGTTCAGCGCCTCACGAAATCCAAAGTTGA
CATCCCTGCACACTGGAGTGATATGAAGCAGCAGAATTTCTGTGTGGTGGAGCTGCTGCCTAGTGATCCTGAGTA
CAACACGGTGGCAAGCAAGTTAATCAGACCTGCTCACACTTCAGAATAGAGAAGATTGAGAGGATCCAGAATCC
AGATCTCTGGAATAGCTACCAGGCAAAGAAAAAAACTATGGATGCCAAGAATGGCCAGACAATGAATGAGAAGCA
ACTCTTCCATGGGACAGATGCCGGCTCCGTGCCACACGTCAATCGAAATGGCTTTAACCGCAGCTATGCCGGAAA
GAATGCCGTGGCATATGGAAAGGGAACCTATTTGCTGTCAATGCCAATTATTCTGCCAATGATACGTACTCCAG
ACCAGATGCAAATGGGAGAAAGCATGTGTATTATGTGCGAGTACTTACTGGAATCTATACACATGGAAATCATTC
ATTAATTGTGCCTCCTTCAAAGAACCCTCAAAATCCTACTGACCTGTATGACACTGTCACAGATAATGTGCACCA
TCCAAGTTTATTTGTGGCATTTTATGACTACCAAGCATACCCAGAGTACCTTATTACGTTTAGAAAATAACACTT
TGGTATCCTTCCCACAAAATTATTCTCCATTTGTACATATCTAGTTGTAAAACAAGTTTTAGCTTTTTTTTTAA
TTCCTCTTAACAGATTTTTCTAATATCCAAGGATCATTCTTTGTCGCTGAAGTCAGTCTTTCTTCAGCTTCTCTT
TCATAATGGAAATGAACTTATTATCTTGAGAGCAAATAACTTGGAAAATTTAAATGAGATAATGCAGTTGCAACT
GTGTGTCCACAAGTATGGACATCAAATCTGTGGGAAAAGAACAGGTTTGTATTTTCAGGAAGGAGAGAATAACAG
TCTTATAGACAGAGGGCACAGCTAAGCACAGCTGCCACTGCAGGAGACAGGCCCCATGTCAGGATGCCATAGTGC
TGTGGGGAGCACAGTATTACCCAGTGGGTAGGGCTTCTGTCTTCCCTGGGAGCAGGGATGGTATCTTAGTCAATT
TTTTTCCCTTGAGATGAGGTCTGTGCCTGATGTACAACGGATACTCCATAAATGTTTGACAAACCAACGAAGAAT
GAAAAAAGCCTAGTCAGACTCCCATCCAAAGTAGGAACTATCTCTTTAACATTCTTGACTCACTATCACTTTAC
CTCAAATTGAACAGATTCCATGACGGAACTTCATTCTTCACAAACTAGCCAGTGACATGTGGGACAGCTCTGGCC
AGGGCTCTGGGACTGCAGTGTACTTGCGCTCTGCACGGTCCAGGAGCTGTGATGTGGCTGTGGTCTAGGGGAATC
CTGCCTGCCCCATGGAGTTGCGCAGCACAACCCTGGCTCCAATTGCCAGAAGGCTCTTTTTAATGCTGAACCAAA
ATGCGCCTTTTTTTTTTTCTGAGATGGAGTTTCACTCTTGTTGCCCAGGCTGGAGTGCAATGGCGCGATCTCAG
CTCACTGCAGCCACTGCCTCCCAGGTTCAAGTGATTCTCCTGCCTCAGCCTCCCGAGTAGCTGGGATTACAGGCA
TGCGCTAACACACCCAGCTAATTTTGTATTTTTAGTAGAGACGAGGTTTCTCCATGTTCGACAGGCTGGTCTCGA
ACTCCCACCTCAGCCTCCCAAACTGCTGGGATTACAGGTGTGAGCCACTGTGACCAGCCAATGTGCCTTCTTATA
GTGTCTACTCATTGGTCTTTGTTCTGCCCAGTGATAACAATGGGATAACGCCTGCTACACATCTTCATTGTGAAA
CCCTTCCCCTGTGCTGAGATTAAATGAACTCTGAGATTATTAAATAGTATATTTCCTTGACAGCCTAGCGTTTG
ATGATTTTAAAGCCTTATGTATAAATAAACCAAAGGAAGTAAGCAGTCATATTGCTAATTTGCTAACTCCTATCT
ATTGAATGGTGAAGTTTTAAAAATTTCCCCAGGTAAGTTTAAGATTCAAACACCATCTATTGAGCACCTACATTG
TGTGCCAGGTAGTAAAATAGGTGCTTTCATACACATTGTCTCAATTCCTGTGAGGTCAGAATTATCTCTGCATTT
GAAACTTGAGGAAACATGCTCAGAGTGCAAGAAGCTTCCTTGCCTGAGATCACCTAGAAAGGAACCCTCAGAGCC
GGCAACTGAATCTTGGTCCCTGTGATGTCAAGCCCATTGCTCTCCCACTGCAGAACATGGCCTCTAGATTAATGC
CACCGATTCAGGAACACCTCCGACAGTCTTGAAATACCCCCATGTTGCCTTGTTTGTTTTTCCTTCTGGCTTCT
TCTATTACAGTCTCTTCATTGGAAGCTCTGTAGGCCAAGGCCAGAGCTGATACTGACACGGAGCCAATGCAGATA
GCACATCAGATGCTAGGGGTCGCTGGGAGGATTAAGGGACTTAATCTGCTAGGAACACCTGTACTTGAAGTGGAG
GAGGCTAGGGGGCCACAGTTGCTGCTTCATTAACATAGAGGTTTTGGATTTTTTTCTCTTGTGGTTTGTTTTTTA
AGTGGATTGGCAGACTCCTTGTTGCTTAAGAGTGGCTTTCTAGGCAGGCCACTGGCATCTGAATTCATCATTGAC
AATAAATGTAAGAAATTGGAATAAAAAGAGAGGCCTGCTGTTATTCGCTTTTGTTCTCCAGTGATTTGATTAAC
TCAGGGCAAGGCTGAATATCAGAGTGTATCGCACTGAAGAATAATAATCCATTCAGTAATGTTATAGTTATCCTC
AATCTAAATATGTCAACTGTCATTTTGCTACTTTTCAAATAAAATACTTGAAAACTGTC
```

FIGURE 145

MKKREGTQLSSQQSVMSKLASFLGFSKQSPQKKNHLVLEKKTESATFRVCGENVTCVEYAISWLQDLIEKEQCPY
TSEDECIKDFDEKEYQELNELQKKLNINISLDHKRPLIKVLGISRDVMQARDEIEAMIKRVRLAKEQESRADCIS
EFIEWQYNDNNTSHCFNKMTNLKLEDARREKKKTVDVKINHRHYTVNLNTYTATDTKGHSLSVQRLTKSKVDIPA
HWSDMKQQNFCVVELLPSDPEYNTVASKFNQTCSHFRIEKIERIQNPDLWNSYQAKKKTMDAKNGQTMNEKQLFH
GTDAGSVPHVNRNGFNRSYAGKNAVAYGKGTYFAVNANYSANDTYSRPDANGRKHVYYVRVLTGIYTHGNHSLIV
PPSKNPQNPTDLYDTVTDNVHHPSLFVAFYDYQAYPEYLITFRK

FIGURE 146

```
GTCGACTACCAGAAAATACTTTCAACATAAATGAACTCTCCAACTTATTAAACTTTTATATAGATAGAGGAAGAC
AGCTCTTTCGGGATAACCACCTGATACCTGCAGAAACCCCCAGTCCTGTTATTTTCAGTGATTTTCCATTTATCT
TTAATTCGCTATCCAAAATTAAATTATTGCAAGCTGATTCACATATAAAGATGCAGATGTCAGAAAAGAAAGCAT
ACATGCTTATGCATGAAACAATTCTGCAAAAAAAGGATGAATTTCCTCCATCACCCAGATTTATACTTAGAGTCA
GACGAAGTCGCCTGGTTAAAGATGCTCTGCGTCAATTAAGTCAAGCTGAAGCTACTGACTTCTGCAAAGTATTAG
TGGTTGAATTTATTAATGAAATTTGTCCTGAGTCTGGAGGGGTTAGTTCAGAGTTCTTCCACTGTATGTTTGAAG
AGATGACCAAGCCAGAATATGGAATGTTCATGTATCCTGAAATGTGTTCCTGCATGTGGTTTCCTGCCAAGCCTA
AACCTGAGAAGAAAAGATATTTCCTCTTTGGAATGCTGTGTGGACTCTCCTTATTCAATTTAAATGTTGCTAACC
TTCCTTTCCCACTGGCTCTGTATAAAAAACTTCTGGACCAAAAGCCATCATTGGAAGATTTAAAAGAACTCAGTC
CTCGGTTGGGGAAGAGTTTGCAAGAAGTTCTAGATGATGCTGCTGATGACATTGGAGATGCGCTCTGCATACGCT
TTTCTATACACTGGGACCAAAATGATGTTGACTTAATTCCAAATGGGATCTCCATACCTGTGGACCAAACCAACA
AGAGAGACTATGTTTCTAAGTATATTGATTACATTTTCAACGTCTCTGTAAAAGCAGTTTATGAGGAATTTCAGA
GAGGATTTTATAGAGTCTGTGAGAAGGAGATACTTAGACATTTCTACCCTGAAGAACTAATGACAGCAATCATTG
GAAATACTGATTATGACTGGAAACAGTTTGAACAGAATTCAAAGTATGAGCAAGGATACCAAAAATCACATCCTA
CTATACAGTTGTTTTGGAAGGCTTTCCACAAGCTAACCTTGGATGAAAAGAAAAAATTCCTCTTTTTCCTTACAG
GACGTGATAGGCTGCATGCAAGAGGCATACAGAAAATGGAAATAGTATTTCGCTGTCCTGAAACTTTCAGTGAAA
GAGATCACCCAACATCAATAACTTGTCATAATATTCTCTCCCTCCCTAAGTATTCTACAATGGAAAGAATGGAGG
AAGCACTCCAAGTAGCCATCAACAACAACAGAGGATTTGTCTCACCCATGCTCACACAGTCATAATCACCTCTGA
GAGACTCAGGGTGGGCTTTCTCACACTTGGATCCTTCTGTTCTTCCTTACACCTAAATAATACAAGAGATTAATG
AATAGTGGTTAGAAGTAGTTGAGGGAGAGATTGGGGGAATGGGGAGATGATGATGATGGTCAAAGGGTGCAAAAT
CTCACACAAGACTGAGGCAGGAGAATAGGGTACAGAGATAGGGATCTAAGGATGACTTGGACACACTCCCTGGCA
CTGAAGAGTCTGAACACTGGCCTGTGATTGGTCCATTCCAGGACCTTCATTTGCATAAGGTATCAAACCACATCA
GCCTCTGATTGGCCATGGGCCAGACCTGCACTCTGGCCAATGATTGGTTCATTCCAGGACATTCATTTGCATAAG
GAGTCAAACCACACCAGTCTTGGATTGGCTGTGAGCCAATTCACCTCAGTCTCTAATTGGCTGTGAGTCAGTCTT
TCATTTACATAGGGTGTAACCATCAAGAAACCTCTACAGGGTACTTAAGCCCCAGAAGATTTTGCTACCAGGGCT
CTTGAGCCACTTGCTCTAGCCCACTCCCACCCTGTGGAATGTACTTTCACTTTTGCTGCTTCACTGCCTTGTGCT
CCAATAAATCCACTCCTTCACCACCCAAAAAAAAAAAAAAAAAAAAAAAAAAAAAAAAAAA
```

FIGURE 147

MQMSEKKAYMLMHETILQKKDEFPPSPRFILRVRRSRLVKDALRQLSQAEATDFCKVLVVEFINEICPESGGVSS
EFFHCMFEEMTKPEYGMFMYPEMCSCMWFPAKPKPEKKRYFLFGMLCGLSLFNLNVANLPFPLALYKKLLDQKPS
LEDLKELSPRLGKSLQEVLDDAADDIGDALCIRFSIHWDQNDVDLIPNGISIPVDQTNKRDYVSKYIDYIFNVSV
KAVYEEFQRGFYRVCEKEILRHFYPEELMTAIIGNTDYDWKQFEQNSKYEQGYQKSHPTIQLFWKAFHKLTLDEK
KKFLFFLTGRDRLHARGIQKMEIVFRCPETFSERDHPTSITCHNILSLPKYSTMERMEEALQVAINNNRGFVSPM
LTQS

FIGURE 148

```
ACAGAAGTGCTAGAAGCCAGTGCTCGTGAACTAAGGAGAAAAAGAACAGACAAGGGAACAGCCTGGACATGGCAT
CAGAGATCCACATGACAGGCCCAATGTGCCTCATTGAGAACACTAATGGGCGACTGATGGCGAATCCAGAAGCTC
TGAAGATCCTTTCTGCCATTACACAGCCTATGGTGGTGGTGGCAATTGTGGGCCTCTACCGCACAGGCAAATCCT
ACCTGATGAACAAGCTGGCTGGAAAGAAAAAGGGCTTCTCTCTGGGCTCCACGGTGCAGTCTCACACTAAAGGAA
TCTGGATGTGGTGTGTGCCCCACCCCAAGAAGCCAGGCCACATCCTAGTTCTGCTGGACACCGAGGGTCTGGGAG
ATGTAGAGAAGGGTGACAACCAGAATGACTCCTGGATCTTCGCCCTGGCCGTCCTCCTGAGCAGCACCTTCGTGT
ACAATAGCATAGGAACCATCAACCAGCAGGCTATGGACCAACTGTACTATGTGACAGAGCTGACACATAGAATCC
GATCAAAATCCTCACCTGATGAGAATGAGAATGAGGTTGAGGATTCAGCTGACTTTGTGAGCTTCTTCCCAGACT
TTGTGTGGACACTGAGAGATTTCTCCCTGGACTTGGAAGCAGATGGACAACCCCTCACACCAGATGAGTACCTGA
CATACTCCCTGAAGCTGAAGAAAGGTACCAGTCAAAAAGATGAAACTTTTAACCTGCCCAGACTCTGTATCCGGA
AATTCTTCCCAAAGAAAAATGCTTTGTCTTGATCGGCCCGTTCACCGCAGGAAGCTTGCCCAGCTCGAGAAAC
TACAAGATGAAGAGCTGGACCCCGAATTTGTGCAACAAGTAGCAGACTTCTGTTCCTACATCTTTAGTAATTCCA
AAACTAAAACTCTTTCAGGAGGCATCCAGGTCAACGGGCCTCGTCTAGAGAGCCTGGTGCTGACCTACGTCAATG
CCATCAGCAGTGGGGATCTGCCGTGCATGGAGAACGCAGTCCTGGCCTTGGCCCAGATAGAGAACTCAGCTGCAG
TGCAAAAGGCTATTGCCCACTATGAACAGCAGATGGGCCAGAAGGTGCAGCTGCCCACAGAAAGCCTCCAGGAGC
TGCTGGACCTGCACAGGGACAGTGAGAGAGAGGCCATTGAAGTCTTCATCAGGAGTTCCTTCAAAGATGTGGACC
ATCTATTTCAAAAGGAGTTAGCGGCCCAGCTAGAAAAAAAGCGGGATGACTTTTGTAAACAGAATCAGGAAGCAT
CATCAGATCGTTGCTCAGGTTTACTTCAGGTCATTTCAGTCCTCTAGAAGAAGAAGTGAAGGCGGGAATTTATT
CGAAACCAGGGGGCTATCGTCTCTTTGTTCAGAAGCTACAAGACCTGAAGAAAAAGTACTATGAGGAACCGAGGA
AGGGGATACAGGCTGAAGAGATTCTGCAGACATACTTGAAATCCAAGGAGTCTATGACTGATGCAATTCTCCAGA
CAGACCAGACTCTCACAGAAAAAGAAAAGGAGATTGAAGTGGAACGTGTGAAAGCTGAGTCTGCACAGGCTTCAG
CAAAAATGTTGCAGGAAATGCAAAGAAAGAATGAGCAGATGATGGAACAGAAGGAGAGGAGTTATCAGGAACACT
TGAAACAACTGACTGAGAAGATGGAGAACGACAGGGTCCAGTTGCTGAAAGAGCAAGAGAGGACCCTCGCTCTTA
AACTTCAGGAACAGGAGCAACTACTAAAAGAGGGATTTCAAAAAGAAAGCAGAATAATGAAAAATGAGATACAGG
ATCTCCAGACGAAAATGAGACGACGAAAGGCATGTACCATAAGCTAAAGACCAGAGCCTTCCTGTCACCCCTAAC
CAAGGCATAATTGAAACAATTTTAGAATTTGGAACAAGCGTCACTACATTTGATAATAATTAGATCTTGCATCAT
AACACCAAAAGTTTATAAAGGCATGTGGTACAATGATCAAAATCATGTTTTTCTTAAAAAAAAAAAAAAGACTG
TAAATTGTGCAACAAAGATGCATTTACCTCTGTATCAACTCAGGAAATCTCATAAGCTGGTACCACTCAGGAGAA
GTTTATTCTTCCAGATGACCAGCAGTAGACAAATGGATACTGAGCAGAGTCTTAGGTAAAAGTCTTGGGAAATAT
TTGGGCATTGGTCTGGCCAAGTCTACAATGTCCCAATATCAAGGACAACCACCCTAGCTTCTTAGTGAAGACAAT
GTACAGTTATCCATTAGATCAAGACTACACGGTCTATGAGCAATAATGTGATTTCTGGACATTGCCCATGTATAA
TCCTCACTGATGATTTCAAGCTAAAGCAAACCACCTTATACAGAGATCTAGAATCTCTTTATGTTCTCCAGAGGA
AGGTGGAAGAAACCATGGGCAGGAGTAGGAATTGAGTGATAAACAATTGGGCTAATGAAGAAAACTTCTCTTATT
GTTCAGTTCATCCAGATTATAACTTCAATGGGACACTTTAGACCATTAGACAATTGACACTGGATTAAACAAATT
CACATAATGCCAAATACACAATGTATTTATAGCAACGTATAATTTGCAAAGATGGACTTTAAAAGATGCTGTGTA
ACTAAACTGAAATAATTCAATTACTTATTATTTAGAATGTTAAAGCTTATGATAGTCTTTCTAATTCTTAACAC
TCATACTTGAAATCTTTCCGAGTTTCCCCAGAAGAGAATATGGGATTTTTTTTGACATTTTTGACCCATTTAATA
ATGCTCTTGTGTTTACCTAGTATATGTAGACTTTGTCTTATGTGTCAAAAGTCCTAGGAAAGTGGTTGATGTTTC
TTATAGCAATTAAAAATTATTTTTGAACTGA
```

FIGURE 149

MASEIHMTGPMCLIENTNGRLMANPEALKILSAITQPMVVVAIVGLYRTGKSYLMNKLAGKKKGFSLGSTVQSHT
KGIWMWCVPHPKKPGHILVLLDTEGLGDVEKGDNQNDSWIFALAVLLSSTFVYNSIGTINQQAMDQLYYVTELTH
RIRSKSSPDENENEVEDSADFVSFFPDFVWTLRDFSLDLEADGQPLTPDEYLTYSLKLKKGTSQKDETFNLPRLC
IRKFFPKKKCFVFDRPVHRRKLAQLEKLQDEELDPEFVQQVADFCSYIFSNSKTKTLSGGIQVNGPRLESLVLTY
VNAISSGDLPCMENAVLALAQIENSAAVQKAIAHYEQQMGQKVQLPTESLQELLDLHRDSEREAIEVFIRSSFKD
VDHLFQKELAAQLEKKRDDFCKQNQEASSDRCSGLLQVIFSPLEEEVKAGIYSKPGGYRLFVQKLQDLKKKYYEE
PRKGIQAEEILQTYLKSKESMTDAILQTDQTLTEKEKEIEVERVKAESAQASAKMLQEMQRKNEQMMEQKERSYQ
EHLKQLTEKMENDRVQLLKEQERTLALKLQEQEQLLKEGFQKESRIMKNEIQDLQTKMRRRKACTIS

FIGURE 150A

```
GCCCTGCTTCCCCTTGCACCTGCGCCGGGCGGCCATGGACTTGTACAGCACCCCGGCCGCTGCGCTGGACAGGTT
CGTGGCCAGAAGGCTGCAGCCGCGGAAGGAGTTCGTAGAGAAGGCGCGGCGCGCTCTGGGCGCCCTGGCCGCTGC
CCTGAGGGAGCGCGGGGGCCGCCTCGGTGCTGCTGCCCCGCGGGTGCTGAAAACTGTCAAGGGAGGCTCCTCGGG
CCGGGGCACAGCTCTCAAGGGTGGCTGTGATTCTGAACTTGTCATCTTCCTCGACTGCTTCAAGAGCTATGTGGA
CCAGAGGGCCCGCCGTGCAGAGATCCTCAGTGAGATGCGGGCATCGCTGGAATCCTGGTGGCAGAACCCAGTCCC
TGGTCTGAGACTCACGTTTCCTGAGCAGACGTGCCTGGGGCCCTGCAGTTCCGCCTGACATCCGTAGATCTTGA
GGACTGGATGGATGTTAGCCTGGTGCCTGCCTTCAATGTCCTGGGTCAGGCCGGCTCCGCGGTCAAACCCAAGCC
ACAAGTCTACTCTACCCTCCTCAACAGTGGCTGCCAAGGGGGCGAGCATGCGGCCTGCTTCACAGAGCTGCGGAG
GAACTTTGTGAACATTCGCCCAGCCAAGTTGAAGAACCTAATCTTGCTGGTGAAGCACTGGTACCACCAGGTGTG
CCTACAGGGGTTGTGGAAGGAGACGCTGCCCCGGTCTATGCCCTGGAATTGCTGACCATCTTCGCCTGGGAGCA
GGGCTGTAAGAAGGATGCTTTCAGCCTAGGCGAAGGCCTCCGAACTGTCCTGGGCCTGATCCAACAGCATCAGCA
CCTGTGTGTTTCTGGACTGTCAACTATGGCTTCGAGGACCCTGCAGTTGGGCAGTTCTTGCAGCGGCACGTTAA
GAGACCCAGGCCTGTGATCCTGGACCCAGCTGACCCCACATGGGACCTGGGGAATGGGGCAGCCTGGCACTGGGA
TTTGCATGCCCAGGAGGCAGCATCCTGCTATGACCACCCATGCTTTCTGAGGGGGATGGGGGACCCAGTGCAGTC
TTGGAAGGGGCCGGGCCTTCCACGTGCTGGATGCTCAGGTTTGGGCCACCCCATCCAGCTAGACCCTAACCAGAA
GACCCCTGAAAACAGCAAGAGCCTCAATGCTGTGTACCCAAGAGCAGGGAGCAAACCTCCCTCATGCCCAGCTCC
TGGCCCCACTGCGGAGCCAGCATCGTACCCCTCTGTGCCGGGAATGGCCTTGGACCTGTCTCAGATCCCCACCAA
GGAGCTGGACCGCTTCATCCAGGACCACCTGAAGCCGAGCCCCCAGTTCCAGGAGCAGGTGAAAAAGGCCATCGA
CATCATCTTGCGCTGCCTCCATGAGAACTGTGTTCACAAGGCCTCAAGAGTCAGTAAAGGGGGCTCATTTGGCCG
GGGCACAGACCTAAGGGATGGCTGTGATGTTGAACTCATCATCTTCCTCAACTGCTTCACGGACTACAAGGACCA
GGGGCCCCGCCGCGCAGAGATCCTTGATGAGATGCGAGCGCACGTAGAATCCTGGTGGCAGGACCAGGTGCCCAG
CCTGAGCCTTCAGTTTCCTGAGCAGAATGTGCCTGAGGCTCTGCAGTTCCAGCTGGTGTCCACAGCCCTGAAGAG
CTGGACGGATGTTAGCCTGCTGCCTGCCTTCGATGCTGTGGGGCAGCTCAGTTCTGGCACCAAACCAAATCCCCA
GGTCTACTCGAGGCTCCTCACCAGTGGCTGCCAGGAGGGCGAGCATAAGGCCTGCTTCGCAGAGCTGCGGAGGAA
CTTCATGAACATTCGCCCTGTCAAGCTGAAGAACCTGATTCTGCTGGTGAAGCACTGGTACCGCCAGGTTGCGGC
TCAGAACAAAGGAAAAGGACCAGCCCCTGCCTCTCTGCCCCCAGCCTATGCCCTGGAGCTCCTCACCATCTTTGC
CTGGGAGCAGGGCTGCAGGCAGGATTGTTTCAACATGGCCCAAGGCTTCCGGACGGTGCTGGGGCTCGTGCAACA
GCATCAGCAGCTCTGTGTCTACTGGACGGTCAACTATAGCACTGAGGACCCAGCCATGAGAATGCACCTTCTTGG
CCAGCTTCGAAAACCCAGACCCCTGGTCCTGGACCCCGCTGATCCCACCTGGAACGTGGGCCACGGTAGCTGGGA
GCTGTTGGCCCAGGAAGCAGCAGCGCTGGGGATGCAGGCCTGCTTTCTGAGTAGAGACGGGACATCTGTGCAGCC
CTGGGATGTGATGCCAGCCCTCCTTTACCAAACCCCAGCTGGGGACCTTGACAAGTTCATCAGTGAATTTCTCCA
GCCCAACCGCCAGTTCCTGGCCCAGGTGAACAAGGCCGTTGATACCATCTGTTCATTTTTGAAGGAAAACTGCTT
CCGGAATTCTCCCATCAAAGTGATCAAGGTGGTCAAGGGTGGCTCTTCAGCCAAAGGCACAGCTCTGCGAGGCCG
CTCAGATGCCGACCTCGTGGTGTTCCTCAGCTGCTTCAGCCAGTTCACTGAGCAGGGCAACAAGCGGGCCGAGAT
CATCTCCGAGATCCGAGCCCAGCTGGAGGCATGTCAACAGGAGCGGCAGTTCGAGGTCAAGTTTGAAGTCTCCAA
ATGGGAGAATCCCCGCGTGCTGAGCTTCTCACTGACATCCCAGACGATGCTGGACCAGAGTGTGGACTTTGATGT
GCTGCCAGCCTTTGACGCCCTAGGCCAGCTGGTCTCTGGCTCCAGGCCCAGCTCTCAAGTCTACGTCGACCTCAT
CCACAGCTACAGCAATGCGGGCGAGTACTCCACCTGCTTCACAGAGCTACAACGGGACTTCATCATCTCTCGCCC
TACCAAGCTGAAGAGCCTGATCCGGCTGGTGAAGCACTGGTACCAGCAGTGTACCAAGATCTCCAAGGGGAGAGG
CTCCCTACCCCACAGCACGGGCTGGAACTCCTGACTGTGTATGCCTGGGAGCAGGGCGGGAAGGACTCCCAGTT
CAACATGGCTGAGGGCTTCCGCACGGTCCTGGAGCTGGTCACCCAGTACCGCCAGCTCTGTATCTACTGGACCAT
CAACTACAACGCCAAGGACAAGACTGTTGGAGACTTCCTGAAACAGCAGCTTCAGAAGCCCAGGCCTATCATCCT
GGATCCGGCTGACCCGACAGGCAACCTGGGCCACAATGCCCGCTGGGACCTGCTGGCCAAGGAAGCTGCAGCCTG
CACATCTGCCCTGTGCTGCATGGGACGGAATGGCATCCCCATCCAGCCATGGCCAGTGAAGGCTGCTGTGTGAAG
TTGAGAAAATCAGCGGTCCTACTGGATGAAGAGAAGATGGACACCAGCCCTCAGCATGAGGAAATTCAGGGTCCC
CTACCAGATGAGAGAGATTGTGTACATGTGTGTGTGAGCACATGTGTGCATGTGTGTGCACACGTGTGCATGTGT
GTGTTTTAGTGAATCTGCTCTCCCAGCTCACACACTCCCCTGCCTCCCATGGCTTACACACTAGGATCCAGACTC
CATGGTTTGACACCAGCCTGCGTTTGCAGCTTCTCTGTCACTTCCATGACTCTATCCTCATACCACCACTGCTGC
```

FIGURE 150B

```
TTCCCACCCAGCTGAGAATGCCCCCTCCTCCCTGACTCCTCTCTGCCCATGCAAATTAGCTCACATCTTTCCTCC
TGCTGCAATCCATCCCTTCCTCCCATTGGCCTCTCCTTGCCAAATCTAAATACTTTATATAGGGATGGCAGAGAG
TTCCCATCTCATCTGTCAGCCACAGTCATTTGGTACTGGCTACCTGGAGCCTTATCTTCTGAAGGGTTTTAAAGA
ATGGCCAATTAGCTGAGAAGAATTATCTAATCAATTAGTGATGTCTGCCATGGATGCAGTAGAGGAAAGTGGTGG
TACAAGTGCCATGATTGATTAGCAATGTCTGCACTGGATATGGAAAAAAGAAGGTGCTTGCAGGTTTACAGTGTA
TATGTGGGCTATTGAAGAGCCCTCTGAGCTCGGTTGCTAGCAGGAGAGCATGCCCATATTGGCTTACTTTGTCTG
CCACAGACACAGACAGAGGGAGTTGGGACATGCATGCTATGGGGACCCTCTTGTTGGACACCTAATTGGATGCCT
CTTCATGAGAGGCCTCCTTTTCTTCACCTTTTATGCTGCACTCCTCCCCTAGTTTACACATCTTGATGCTGTGGC
TCAGTTTGCCTTCCTGAATTTTTATTGGGTCCCTGTTTTCTCTCCTAACATGCTGAGATTCTGCATCCCCACAGC
CTAAACTGAGCCAGTGGCCAAACAACCGTGCTCAGCCTGTTTCTCTCTGCCCTCTAGAGCAAGGCCCACCAGGTC
CATCCAGGAGGCTCTCCTGACCTCAAGTCCAACAACAGTGTCCACACTAGTCAAGGTTCAGCCCAGAAAACAGAA
AGCACTCTAGGAATCTTAGGCAGAAAGGGATTTTATCTAAATCACTGGAAAGGCTGGAGGAGCAGAAGGCAGAGG
CCACCACTGGACTATTGGTTTCAATATTAGACCACTGTAGCCGAATCAGAGGCCAGAGAGCAGCCACTGCTACTG
CTAATGCCACCACTACCCCTGCCATCACTGCCCACATGGACAAAACTGGAGTCGAGACCTAGGTTAGATTCCTG
CAACCACAAACATCCATCAGGGATGGCCAGCTGCCAGAGCTGCGGGAAGACGGATCCCACCTCCCTTTCTTAGCA
GAATCTAAATTACAGCCAGACCTCTGGCTGCAGAGGAGTCTGAGACATGTATGATTGAATGGGTGCCAAGTGCCA
GGGGGCGGAGTCCCCAGCAGATGCATCCTGGCCATCTGTTGCGTGGATGAGGGAGTGGGTCTATCTCAGAGGAAG
GAACAGGAAACAAAGAAAGGAAGCCACTGAACATCCCTTCTCTGCTCCACAGGAGTGTCTTAGACAGCCTGACTC
TCCACAAACCACTGTTAAAACTTACCTGCTAGGAATGCTAGATTGAATGGGATGGGAAGAGCCTTCCCTCATTAT
TGTCATTCTTGGAGAGAGGTGAGCAACCAAGGGAAGCTCCTCTGATTCACCTAGAACCTGTTCTCTGCCGTCTTT
GGCTCAGCCTACAGAGACTAGAGTAGGTGAAGGGACAGAGGACAGGGCTTCTAATACCTGTGCCATATTGACAGC
CTCCATCCCTGTCCCCCATCTTGGTGCTGAACCAACGCTAAGGGCACCTTCTTAGACTCACCTCATCGATACTGC
CTGGTAATCCAAAGCTAGAACTCTCAGGACCCCAAACTCCACCTCTTGGATTGGCCCTGGCTGCTGCCACACACA
TATCCAAGAGCTCAGGGCCAGTTCTGGTGGGCAGCAGAGACCTGCTCTGCCAAGTTGTCCAGCAGCAGAGTGGCC
CTGGCCTGGGCATCACAAGCCAGTGATGCTCCTGGGAAGACCAGGTGGCAGGTCGCAGTTGGGTACCTTCCATTC
CCACCACACAGACTCTGGGCCTCCCCGCAAAATGGCTCCAGAATTAGAGTAATTATGAGATGGTGGGAACCAGAG
CAACTCAGGTGCATGATACAAGGAGAGGTTGTCATCTGGGTAGGGCAGAGAGGAGGGCTTGCTCATCTGAACAGG
GGTGTATTTCATTCCAGGCCCTCAGTCTTTGGCAATGGCCACCCTGGTGTTGGCATATTGGCCCCACTGTAACTT
TTGGGGGCTTCCCGGTCTAGCCACACCCTCGGATGGAAAGACTTGACTGCATAAAGATGTCAGTTCTCCCTGAGT
TGATTGATAGGCTTAATGGTCACCCTAAAAACACCCACATATGCTTTTCGATGGAACCAGATAAGTTGACGCTAA
AGTTCTTATGGAAAAATACACACGCAATAGCTAGGAAAACACAGGGAAAGAAGAGTTCTGAGCAGGGCCTAGTCT
TAGCCAATATTAAAACATACTATGAAGCCTCTGATACTTAAACAGCATGGCGCTGGTACGTAAATAGACCAATGC
AGTTAGGTGGCTCTTTCCAAGACTCTGGGGAAAAAAGTAGTAAAAAGCTAAATGCAATCATCAGCAATTGAAAG
CTAAGTGAGAGAGCCAGAGGGCCTCCTTGGTGGTAAAAGAGGGTTGCATTTCTTGCAGCCAGAAGGCAGAGAAAG
TGAAGACCAAGTCCAGAACTGAATCCTAAGAAATGCAGGACTGCAAAGAAATTGGTGTGTGTGTGTGTGTGTGTG
TGTGTGTGTGTTTAATTTTTAAAAAGTTTTTATTCGGAATCCGCG
```

FIGURE 151

MDLYSTPAAALDRFVARRLQPRKEFVEKARRALGALAAALRERGGRLGAAAPRVLKTVKGGSSGRGTALKGGCDS
ELVIFLDCFKSYVDQRARRAEILSEMRASLESWWQNPVPGLRLTFPEQSVPGALQFRLTSVDLEDWMDVSLVPAF
NVLGQAGSAVKPKPQVYSTLLNSGCQGGEHAACFTELRRNFVNIRPAKLKNLILLVKHWYHQVCLQGLWKETLPP
VYALELLTIFAWEQGCKKDAFSLGEGLRTVLGLIQQHQHLCVFWTVNYGFEDPAVGQFLQRHVKRPRPVILDPAD
PTWDLGNGAAWHWDLHAQEAASCYDHPCFLRGMGDPVQSWKGPGLPRAGCSGLGHPIQLDPNQKTPENSKSLNAV
YPRAGSKPPSCPAPGPTAEPASYPSVPGMALDLSQIPTKELDRFIQDHLKPSPQFQEQVKKAIDIILRCLHENCV
HKASRVSKGGSFGRGTDLRDGCDVELIIFLNCFTDYKDQGPRRAEILDEMRAHVESWWQDQVPSLSLQFPEQNVP
EALQFQLVSTALKSWTDVSLLPAFDAVGQLSSGTKPNPQVYSRLLTSGCQEGEHKACFAELRRNFMNIRPVKLKN
LILLVKHWYRQVAAQNKGKGPAPASLPPAYALELLTIFAWEQGCRQDCFNMAQGFRTVLGLVQQHQQLCVYWTVN
YSTEDPAMRMHLLGQLRKPRPLVLDPADPTWNVGHGSWELLAQEAAALGMQACFLSRDGTSVQPWDVMPALLYQT
PAGDLDKFISEFLQPNRQFLAQVNKAVDTICSFLKENCFRNSPIKVIKVVKGGSSAKGTALRGRSDADLVVFLSC
FSQFTEQGNKRAEIISEIRAQLEACQQERQFEVKFEVSKWENPRVLSFSLTSQTMLDQSVDFDVLPAFDALGQLV
SGSRPSSQVYVDLIHSYSNAGEYSTCFTELQRDFIISRPTKLKSLIRLVKHWYQQCTKISKGRGSLPPQHGLELL
TVYAWEQGGKDSQFNMAEGFRTVLELVTQYRQLCIYWTINYNAKDKTVGDFLKQQLQKPRPIILDPADPTGNLGH
NARWDLLAKEAAACTSALCCMGRNGIPIQPWPVKAAV

FIGURE 152

```
TTTACCTGAAAGCTACGTGAATCGTTGGTAAATTGGTGTAAAAATGGAACTGAGTCATCTCAAAAGTTCCTTTCA
GTTCTAAAATTCTGTGAATTGAAGCCTACTTTTTCACTTTAAATGATTTATTGGGTTTACAGTTCTTTACGCTTT
CTGATTGAACTGATTTGAAGTTCTTATTTCGTGTGTTGGGGAACACACCCCCAACCCGTCACAGCGTGGCCGTGG
GTGGGAGATGGACGTTAGGCTGGCCAGTCACTAGGGGGCAGCATCAGCACGGGTCTGGCTGTCCCTGGCCTTAGG
GAGCAGTTTCTGCCCCTCCTGCCCCGTCAGAAAGTCTCGGACTCCTCTCTGCTTGCATGTGTAAAGTTTTCATTT
TCAGGGGCCTTTTAGTCAAAAAAAATAAAGCTGTATGATTTAGTGCTGAAGGATATGAATTAGGCATAGCTCTTG
GGTTGGCAGCATAAACCAAGGGGCATCAACCCACCACCAACAAGCTAAGAATGGTTTTTACATCTTTAAATGGTT
GAAAAAGGAAAAAGAATGTTTAGTGACACGTGAAAAATACATGAAATTCAAACTTCAATGTCTACAAATAAAGTG
CATTAGCACACGGTCGTCTTGCTTCTCAAAAAA
```

FIGURE 153

MKFKLQCLQIKCISTRSSCFSK

FIGURE 154

```
ATCTGAAAAATTAATAATTCCTTAATTATCAAATATCCATTATTTAAATTTATAATTGTGTCATAAATATTGTCA
TAAATAGATTTGCTGTTTTAAAGCTTGTTCCTTCATTTTCTCTGTTTTGTTTAGATAAACATTGTCATAAATAG
ATTTGTTGTTTTAAAGCTTGTTCCTTCATTTTCTCTGATTGTTTTGTTTAGATTCAGAGGTTACTTATGCTTGT
TTGTTACATGGATGTTACATGTGTAATGGGGGATATTGGACTTCTAGTGTACTCATCACCCATATACTGAACACT
GTACTCAAAAGGGATTGAAAGAAACTAGGAAACTTGGCAGGAAGATCATTCTTAAGCCAGGAAAAAAATTTTTAA
TGCTCACATGTGAACATGTGATGGTCATACCAGAAGGAGCACCCACCTCCCTCCCTCTGTGACAGACACATTTTC
TTAGCCTTCACCTTTCCTTCTTTCAAGTTGCTGAAAATCCACAGTGTTTCTGTTCATTTGTTACTTTCATTCTCA
CCTATCTTCTCTCTTGCTCCATCTACCAGAACAATAATTCCCCATATAATACTTCTCACTTCACTTTTCAACGCA
GGACCTCTTGTTGGTCTGATCTGTTTGTCTGTCCGCTTTATCAATATTATCAGATGTAAGTTTACATGAATACAC
ACACATATTCACTAAACTGAGGGGAAAAAATGCCTTGTAGGTCATAAAAAAGCAGGGAAATTCCCAACAATTCAT
ATTTGATCCCTGGATCCAGGGGTGGCAGCAATAAGCCTGCTTTAGATATTTACTCCCCATTTTATGATCCGGTGG
TTTGGTTTTTCAAATGATGATATGGCTCCTTTCGCAATGACTTGATGTTTAGGAGGTGTGCTTCAATAAATACAT
TTTAAAATCAACAATCAAGTTAGAGTTGTACAAATGGCTCTGAAATGTCCCACTACACTGTTAGACCAAGGGCAC
AGATTGTGCTTCTGTACTATTTATCCTAGTATCCCTCGGCATATATTAACTGCTCTAAAAATCTCCTTGGCTACA
CGCTGCATCAAATCAAAGTTAAATGTTATACCACCTTTCTATTCTATTTTAATATTCAAAGAGGGTGCTCAGAT
TTTAGAACAAATTTCAATGTTTAAGTACACACAAAAAAATCATTAACTCATATATTTCAAGAGTAGGAAATGGGA
ACTGGTGTTAAAACTCTTATAACAAATGTCACTGTCTTAAGGGACAGTGTTTAAAAACGCATACCTGGCCGGGCG
CGGTGGCTCATGCCTGTAATCCCAGCACTTTGGGAGGCCGAGGCCGGCGGATCACAAGGAAAACAAACTCAGGAA
GAAAAAGGAAAGCAGAAGTGATCAAGGAGAGCGCTCGAGTTGCAATATTTCCTTTGGCTGCTGACAGGCAGTTA
CTATAAAGCATTGTGCATGGACACCATCTTCTTGTATTATACAAGAAAGGAGTGTACCTATCACACACAGGGGGA
AAA<u>ATG</u>CTCTTTTGGGTGCTAGGCCTCCTAATCCTCTGTGGTTTTCTGTGGACTCGTAAAGGAAAACTAAAGATT
GAAGACATCACTGATAAGTACATTTTTATCACTGGATGTGACTCGGGCTTTGGAAACTTGGCAGCCAGAACTTTT
GATAAAAAGGGGATTTCATGTAATCGCTGCCTGTCTGACTGAATCAGGATCAACAGCTTTAAAGGCAGAAACCTCA
GAGAGACTTCGTACTGTGCTTCTGGATGTGACCGACCCAGAGAATGTCAAGAGGACTGCCCAGTGGGTGAAGAAC
CAAGTTGGGGAGAAAGGTCTCTGGGGTCTGATCAATAATGCTGGTGTTCCCGGCGTGCTGGCTCCCACTGACTGG
CTGACACTAGAGGACTACAGAGAACCTATTGAAGTGAACCTGTTTGGACTCATCAGTGTGACACTAAATATGCTT
CCTTTGGTCAAGAAAGCTCAAGGGAGAGTTATTAATGTCTCCAGTGTTGGAGGTCGCCTTGCAATCGTTGGAGGG
GGCTATACTCCATCCAAATATGCAGTGGAAGGTTTCAATGACAGCTTAAGACGGGACATGAAAGCTTTTGGTGTG
CACGTCTCATGCATTGAACCAGGATTGTTCAAAACAAACTTGGCAGATCCAGTAAAGGTAATTGAAAAAAAAACTC
GCCATTTGGGAGCAGCTGTCTCCAGACATCAAACAACAATATGGAGAAGGTTACATTGAAAAAAAGTCTAGACAAA
CTGAAAGGCAATAAATCCTATGTGAACATGGACCTCTCTCCGGTGGTAGAGTGCATGGACCACGCTCTAACAAGT
CTCTTCCCTAAGACTCATTATGCCGCTGGAAAAGATGCCAAAATTTTCTGGATACCTCTGTCTCACATGCCAGCA
GCTTTGCAAGACTTTTTATTGTTGAAACAGAAAGCAGAGCTGGCTAATCCCAAGGCAGTG<u>TGA</u>CTCAGCTAACCA
CAAATGTCTCCTCCAGGCTATGAAATTGGCCGATTTCAAGAACACATCTCCTTTTCAACCCCATTCCTTATCTGC
TCCAACCTGGACTCATTTAGATCGTGCTTATTTGGATTGCAAAAGGGAGTCCCACCATCGCTGGTGGTATCCCAG
GGTCCCTGCTCAAGTTTTCTTTGAAAAGGAGGGCTGGAATGGTACATCACATAGGCAAGTCCTGCCCTGTATTTA
GGCTTTGCCTGCTTGGTGTGATGTAAGGGAAATTGAAAGACTTGCCCATTCAAAATGATCTTTACCGTGGCCTGC
CCCATGCTTATGGTCCCCAGCATTTACAGTAACTTGTGAATGTTAAGTATCATCTCTTATCTAAATATTAAAAGA
TAAGTCAAACATT
```

FIGURE 155

MLFWVLGLLILCGFLWTRKGKLKIEDITDKYIFITGCDSGFGNLAARTFDKKGFHVIAACLTESGSTALKAETSE
RLRTVLLDVTDPENVKRTAQWVKNQVGEKGLWGLINNAGVPGVLAPTDWLTLEDYREPIEVNLFGLISVTLNMLP
LVKKAQGRVINVSSVGGRLAIVGGGYTPSKYAVEGFNDSLRRDMKAFGVHVSCIEPGLFKTNLADPVKVIEKKLA
IWEQLSPDIKQQYGEGYIEKSLDKLKGNKSYVNMDLSPVVECMDHALTSLFPKTHYAAGKDAKIFWIPLSHMPAA
LQDFLLLKQKAELANPKAV

FIGURE 156A

CTGGCGCGCGCACGCGCACGCGCACGCCCACCGCGCGGCTTCCCCCGCTCCCCGGTGCTGAGGAGAGAGCGATCC
GAGGGACTGCGCCGCCCGGACGGCCTGCAGAGCGCTGCCATCATGAGTGAAATTCGTAAGGACACCTTGAAGGCC
ATTCTGTTGGAGTTAGAATGTCATTTTACATGGAATTTACTTAAGGAAGACATTGATCTGTTTGAGGTAGAAGAT
ACAATTGGGCAACAGCTTGAATTTCTTACCACAAAATCTAGACTTGCTCTTTATAACCTATTGGCCTATGTGAAA
CACCTAAAAGGCCAAAATAAAGACGCCCTTGAGTGCTTGGAACAAGCAGAAGAAATAATCCAGCAAGAACACTCA
GACAAAGAAGAAGTACGAAGCCTGGTCACTTGGGGAAACTATGCCTGGGTGTATTATCACATGGACCAGCTTGAA
GAAGCTCAGAAGTATACAGGTAAGATAGGGAATGTCTGTAAGAAATTGTCCAGTCCTTCTAACTACAAGTTGGAG
TGTCCTGAGACTGACTGTGAGAAAGGCTGGGCACTCTTGAAATTTGGAGGAAAGTATTATCAAAAGGCTAAAGCG
GCTTTTGAGAAGGCTCTGGAAGTGGAGCCTGACAATCCAGAATTTAACATCGGCTATGCTATCACAGTGTATCGG
CTGGATGATTCTGATAGAGAAGGGTCTGTAAAGAGCTTTTCTCTGGGGCCTTTGAGAAAGGCTGTTACCCTGAAC
CCAGATAACAGCTATATTAAGGTTTTTCTGGCACTGAAGCTTCAAGATGTACATGCAGAAGCTGAAGGGGAAAAG
TATATTGAAGAAATCCTGGACCAAATATCATCCCAGCCTTACGTCCTTCGTTATGCAGCCAAGTTCTATAGGAGA
AAAAATTCCTGGAACAAAGCTCTCGAACTTTTAAAAAAGGCCTTGGAGGTGACACCAACTTCTTCTTTCCTGCAT
CACCAGATGGGACTTTGCTACAGGGCACAAATGATCCAAATCAAGAAGGCCACACACAACAGACCTAAAGGAAAG
GATAAACTAAAGGTTGATGAGCTGATTTCATCTGCTATATTTCATTTCAAAGCAGCCATGGAACGAGACTCTATG
TTTGCATTTGCCTACACAGACCTGGCCAACATGTATGCTGAAGGAGGCCAGTATAGCAATGCTGAGGACATTTTC
CGGAAAGCTCTTCGTCTGGAGAACATAACCGATGATCACAAACATCAGATCCATTACCACTATGGCCGCTTTCAG
GAATTTCACCGTAAATCAGAAAATACTGCCATCCATCATTATTTAGAAGCCTTAAAGGTCAAAGACAGATCACCC
CTTCGCACCAAACTGACAAGTGCTCTGAAGAAATTGTCTACCAAGAGACTTTGTCACAATGCTTTAGATGTGCAG
AGTTTAAGTGCCCTAGGGTTTGTTTACAAGCTGGAAGGAGAAAAGAGGCAAGCTGCTGAGTACTATGAGAAGGCA
CAAAAGATAGATCCAGAAAATGCAGAATTCCTGACTGCTCTCTGTGAGCTCCGACTTTCCATTTAAATACATACT
CTAGGAAATTAGCTCTAAGTTTTTCCCTTCATTTGGGTTCTCCTGTTTGTTTTTTTTATTATTTTAATCCCT
TGTTTATTATAGAGCTAATATTTATTGAATAGTTATTGTGTACCAAGCATTGTGCTAAATACTTTATATGCATTA
TGATGAATCTTGTGCGGTTTTCTTTCTTTTTTCTTTTAATTAAAATACTATAATCCATTGAGAAATAGCAATA
TTCTAGCTATTGTAACTTCTAAAAATGGTATGGCCATTAGATCTGTGCTTTTATCTCTGCTCTTTGAATTTCTC
ATATTATATAGTAAATATATTCCTACGTAAACCTTTGATACCTAGATCAGGAATACTCTTCCAGGAGTACAAAAT
TACATTATTGATAGTTAAGCTCTTAATTGTGTAGCTTGCAAAAGACAGCACTTTTTAGTTACAGATGTTTTGACT
TTGATGAGGATATTTAGCTATCAATCTAATAGTCACCTAAAATATCTTTTTTGTTGGAAAAAAGTTTATAATAAA
AAAGTTTGTCATCTCTAGTGACTTCAATAAAGAAAAAACTAGAAGAGGAGAAAAAGGATTTCCTCAAATTTTAAA
TATGTAACTTCAGGGATTCAATCCCCAAATGTTTATTAAGTAGCTAGAAATAATTATGTGGAAAAAAATGAATAA
TGGAAAATAGTGAGTCTCAAATTGTTTTTTTTAACTAAAATCTGCAATGAATCTAGATGCAATTAATTTTATTC
CTTCCAACTAAAATTACAATATTTTAGGTTAAAATTATTGAGATATAAAGCAGCCATTGGGAAATTGGGAGAAA
TGATAAACAAATGGAAAAAGAAGATGTCCCTAACCTACACCCATAGATTACCAAGGTTTCAGTGTACTAGTTTTG
AATCTGTTCTGAATGGAGTTTTTATACCCTCAATTTCTGGCCTTTGGCTATTTTAGCATTTCAAAGTGACTTCTA
TGAAGCTTTTTTTTAATGTGAAATTTTCAGAATGTTGTTTTTTCATGTAGATACTCCAGGAAGAGTTAAGCAC
TGCTTTCAGTTTTAATATCCACCTTGAGGGGTCGCTGCTTGAGGGCTCTTATCCCAGGGGACTTTTTAATTCGGA
TGTTACTTAATGTGGCTTCTCTAATGTAGTTTCTTTGATTACCGACTACACAATTATGTACCATCACAGTATTAG
TGGAAAAGTACCATGTGATTTAATTCTCCATTCCTCCAATGTAACTCTTAAAATTATTATGTATGTGTATGTGTT
TTACTTTTTGTTTTTTATCATCTTTAAAATTTCTATTATGGTTTGATTATTATAAAAATAATGAATTCTCACTGT
AAATTTCAAAAAAAAAATTACAAAAGTATGTGAATTTAAAAATGAGAGCAGTCCCCTCACCCTACCACAGTTCCA
CACCCTCAAGGTAAACTTATAACTTATAATTTGATATGTAAACTTCCAGATCTTTTTCTATGCGTAATCAGACA
TACATATATACTGCAGTGTATCTCACGTATTAATTTTAAAAATCTTTTGTTTTACTTAATTCTGTTTTTATTAT
TATTATTATTTTGTTTGATCTATTAAGGAAGAACAAGGAAGGGAATGATCTTTACTCAAGAATTTCAGAAAGTCA
GCACTGAAGTCCTGACCTATCAGTAGACACATTTGTCCCTTTCAGATATTTTAGGATATTCTAGCAAAGCAGGCC
ATTTCTCCCACCTGAAAGTACATAACTTCTATCACTTGCCACATAATTAAAAGAACTCACATTAAGCGGTTACTC
AGACAGTTAATCATAGAAAAGATTATTTGCTTCATCAGTTCATAGAAAAGATTATTTGCTTCATCAGTTAACTTG
TTTTTATAAATCAGGGCCTGTGTTCATACACAGAAGGGGCCTGAGATTTCTGCACTTTAAACAAGCTCCTCCTAG
GTGAGGATGCTGTGGCTGTTCTAATTACATTTTGAGTAGTAAGGTCTACAGCATTGTTCCTCAAACTTGGCTACG

FIGURE 156B

```
TATTGGAATCACCTAAAAAGTTAAAACAAAACATGGATGTCTGGGTCCCGCCCCATAGAGAATGACTTAATTGGC
ATGGGGTGCAGTCCAGGCATCATGATTTTTAGATTTCCCAGTTGGAACTTGTGCAGCAAAGTTTGGGAGCTACTG
ATGGACATGTGAAAAGTAAGTATAAATGGAATAAAATTAATTAGGCTAATAGGCTTAACCCAGGAAATCCTAAGT
TCCTTGAATATCCAGTTTGCATTTGGGACTCCTCATCATATACTTGGTATATAATACTCTAATAAAAGCTGCCTG
AGTTGA
```

FIGURE 157

MSEIRKDTLKAILLELECHFTWNLLKEDIDLFEVEDTIGQQLEFLTTKSRLALYNLLAYVKHLKGQNKDALECLE
QAEEIIQQEHSDKEEVRSLVTWGNYAWVYYHMDQLEEAQKYTGKIGNVCKKLSSPSNYKLECPETDCEKGWALLK
FGGKYYQKAKAAFEKALEVEPDNPEFNIGYAITVYRLDDSDREGSVKSFSLGPLRKAVTLNPDNSYIKVFLALKL
QDVHAEAEGEKYIEEILDQISSQPYVLRYAAKFYRRKNSWNKALELLKKALEVTPTSSFLHHQMGLCYRAQMIQI
KKATHNRPKGKDKLKVDELISSAIFHFKAAMERDSMFAFAYTDLANMYAEGGQYSNAEDIFRKALRLENITDDHK
HQIHYHYGRFQEFHRKSENTAIHHYLEALKVKDRSPLRTKLTSALKKLSTKRLCHNALDVQSLSALGFVYKLEGE
KRQAAI(YEKAQKIDPENAEFLTALCELRLSI

FIGURE 158

GGAAAGCTGCCATCAGCTGAGCAAGTCCACCAACAGTTTCTGTGTCCCACTTCATCTTTAATAAGGACACCATCT
TCTTGTATTATACAAGAAAGGAGTGTACCTATCACACACAGGGGGAAAAATGCTCTTTTGGGTGCTAGGCCTCCT
AATCCTCTGTGGTTTTCTGTGGACTCGTAAAGGAAAACTAAAGATTGAAGACATCACTGATAAGTACATTTTTAT
CACTGGATGTGACTCGGGCTTTGGAAACTTGGCAGCCAGAACTTTTGATAAAAAGGGATTTCATGTAATCGCTGC
CTGTCTGACTGAATCAGGATCAACAGCTTTAAAGGCAGAAACCTCAGAGAGACTTCGTACTGTGCTTCTGGATGT
GACCGACCCAGAGAATGTCAAGAGGACTGCCCAGTGGGTGAAGAACCAAGTTGGGGAGAAAGGTCTCTGGGGTCT
GATCAATAATGCTGGTGTTCCCGGCGTGCTGGCTCCCACTGACTGGCTGACACTAGAGGACTACAGAGAACCTAT
TGAAGTGAACCTGTTTGGACTCATCAGTGTGACACTAAATATGCTTCCTTTGGTCAAGAAAGCTCAAGGGAGAGT
TATTAATGTCTCCAGTGTTGGAGGTCGCCTTGCAATCGTTGGAGGGGGCTATACTCCATCCAAATATGCAGTGGA
AGGTTTCAATGACAGCTTAAGACGGGACATGAAAGCTTTTGGTGTGCACGTCTCATGCATTGAACGTCTAGACAA
ACTGAAAGGCAATAAATCCTATGTGAACATGGACCTCTCTCCGGTGGTAGAGTGCATGGACCACGCTCTAACAAG
TCTCTTCCCTAAGACTCATTATGCCGCTGGAAAAGATGCCAAAATTTTCTGGATACCTCTGTCTCACATGCCAGC
AGCTTTGCAAGACTTTTTATTGTTGAAACAGAAAGCAGAGCTGGCTAATCCCAAGGCAGTGTGACTCAGCTAACC
ACAAATGTCTCCTCCAGGCTATGAAATTGGCCGATTTCAAGAACACATCTCCTTTTCAACCCCATTCCTTATCTG
CTCCAACCTGGACTCATTTAGATCGTGCTTATTTGGATTGCAAAAGGGAGTCCCACCATCGCTGGTGGT

FIGURE 159

MLFWVLGLLILCGFLWTRKGKLKIEDITDKYIFITGCDSGFGNLAARTFDKKGFHVIAACLTESGSTALKAETSE
RLRTVLLDVIDPENVKRTAQWVKNQVGEKGLWGLINNAGVPGVLAPTDWLTLEDYREPIEVNLFGLISVTLNMLP
LVKKAQGRVINVSSVGGRLAIVGGGYTPSKYAVEGFNDSLRRDMKAFGVHVSCIERLDKLKGNKSYVNMDLSPVV
ECMDHALTSLFPKTHYAAGKDAKIFWIPLSHMPAALQDFLLLKQKAELANPKAV

FIGURE 160

TCGAATTCCTAATTTTTGTGGGACTCCTTAAGACCCACAAGTGACTTCTGTCTACACTACAGATGAACTGAATTG
ATCATCTAAAATACGTTTATAGCGTTCATTGTGCCAGTTGCTCATGGTTCTGCTAATTGGCCCAGGACTAGTTGT
GATCTGCAGACTGAAGCCAGAGTAAGTAAGAGAATTCAAGGCACTAAGACAACCAGGAACAGTTTTACCAAGGCA
AGTGGAAGCTGCTAGGCTCAGTGGTTGCATGCCTATAGATGGGGTAAATCATCCTGGTGCAAATATGGTATTCAC
ACCATAAATGTGTAGTGCAAGTTTCCTCTGTGGCCAATCACAGGGCTGCAAGCTGAAGCCCCAGTTTAGCTTATT
CTCCATACATAACTTCAAGGGGACTTTCTGGTGAACTTTTCCAAGAAGCTCCAAGCACAG<u>ATG</u>GTTCAAATTTGC
AGTTTGGCTAGACTTTGTGACTGGATGTACATTAAATTAA

MVQICSLARLCDWMYIK

```
TTGGAACCAGAGAGAAGCCGGGATGGAAACTCCAAACACCACAGAGGACTATGACACGACCACAGAGTTTGACTA
TGGGGATGCAACTCCGTGCCAGAAGGTGAACGAGAGGGCCTTTGGGGCCCAACTGCTGCCCCCTCTGTACTCCTT
GGTATTTGTCATTGGCCTGGTTGGAAACATCCTGGTGGTCCTGGTCCTTGTGCAATACAAGAGGCTAAAAAACAT
GACCAGCATCTACCTCCTGAACCTGGCCATTTCTGACCTGCTCTTCCTGTTCACGCTTCCCTTCTGGATCGACTA
CAAGTTGAAGGATGACTGGGTTTTTGGTGATGCCATGTGTAAGATCCTCTCTGGGTTTTATTACACAGGCTTGTA
CAGCGAGATCTTTTTCATCATCCTGCTGACGATTGACAGGTACCTGGCCATCGTCCACGCCGTGTTTGCCTTGCG
GGCACGGACCGTCACTTTTGGTGTCATCACCAGCATCATCATTGGGCCCTGGCCATCTTGGCTTCCATGCCAGG
CTTATACTTTTCCAAGACCCAATGGGAATTCACTCACCACACCTGCAGCCTTCACTTTCCTCACGAAAGCCTACG
AGAGTGGAAGCTGTTTCAGGCTCTGAAACTGAACCTCTTTGGGCTGGTATTGCCTTTGTTGGTCATGATCATCTG
CTACACAGGGATTATAAAGATTCTGCTAAGACGACCAAATGAGAAGAAATCCAAAGCTGTCCGTTTGATTTTTGT
CATCATGATCATCTTTTTCTCTTTTGGACCCCCTACAATTTGACTATACTTATTTCTGTTTTCCAAGACTTCCT
GTTCACCCATGAGTGTGAGCAGAGCAGACATTTGGACCTGGCTGTGCAAGTGACGGAGGTGATCGCCTACACGCA
CTGCTGTGTCAACCCAGTGATCTACGCCTTCGTTGGTGAGAGGTTCCGGAAGTACCTGCGGCAGTTGTTCCACAG
GCGTGTGGCTGTGCACCTGGTTAAATGGCTCCCCTTCCTCTCCGTGGACAGGCTGGACAGGGTCAGCTCCACATC
TCCCTCCACAGGGGAGCATGAACTCTCTGCTGGGTTCTGACTCAGACCATAGGAGGCCAACCCAAAATAAGCAGG
CGTGACCTGCCAGGCACACTGAGCCAGCAGCCTGGCTCTCCCAGCCAGGTTCTGACTCTTGGCACAGCATGGAGT
CACAGCCACTTGGGATAGAGAGGGAATGTAATGGTGGCCTGGGGCTTCTGAGGCTTCTGGGGCTTCAGTCTTTTC
CATGAACTTCTCCCCTGGTAGAAAGAAGATGAATGAGCAAAACCAAATATTCCAGAGACTGGGACTAATGTACCA
GAGAAGGGCTTGGACTCAAGCAAGATTTCAGATTTGTGACCATTAGCATTTGTCAACAAAGTCACCCACTTCCCA
CTATTGCTTGCACAAACCAATTAAACCCAGTAGTGGTGACTGTGGGCTCCATTCAAAGTGAGCTCCTAAGCCATG
GGAGACACTGATGTATGAGGAATTTCTGTTCTTCCATCACCTCCCCCCCCCGCCACCCTCCCACTGCCAAAGAA
CTTGGAAATAGTGATTTCCACAGTGACTCCACTCTGAGTCCCAGAGCCAATCAGTAGCCAGCATCTGCCTCCCCT
TCACTCCCACCGCAGATTTGGGCTCTTGGAATCCTGGGGAACATAGAACTCATGACGGAAGAGTTGAGACCTAAC
GAGAAATAGAAATGGGGAACTACTGCTGGCAGTGGAACTAAGAAAGCCCTTAGGAAGAATTTTTATATCCACTAA
AATCAAACAATTCAGGGAGTGGGCTAAGCACGGGCCATATGAATAACATGGTGTGCTTCTTAAAATAGCCATAAA
GGGGAGGGACTCATCATTTCCATTTACCCTTCTTTTCTGACTATTTTTCAGAATCTCTCTTCTTTTCAAGTTGGG
TGATATGTTGGTAGATTCTAATGGCTTTATTGCAGCGGTTAATAACAGGCAAAAGGAAGCAGGGTTGGTTTCCCT
TCTTTTTGTTCTTCATCTAAGCCTTCTGGTTTTATGGGTCAGAGTTCCGACTGCCATCTTGGACTTGTCAGCAAA
AAAAAATAATAATAATAATAATAAGGCCTGCTGTGTAAGCTGACAGTATTTGTAGCTGATAGGGGGTTGGGAGGA
AGTGTCTACTAGGAGGGTGGGTGAGATCTGTGTTGATGT
```

FIGURE 163

METPNTTEDYDTTTEFDYGDATPCQKVNERAFGAQLLPPLYSLVFVIGLVGNILVVLVLVQYKRLKNMTSIYLLN
LAISDLLFLFTLPFWIDYKLKDDWVFGDAMCKILSGFYYTGLYSEIFFIILLTIDRYLAIVHAVFALRARTVTFG
VITSIIIWALAILASMPGLYFSKTQWEFTHHTCSLHFPHESLREWKLFQALKLNLFGLVLPLLVMIICYTGIIKI
LLRRPNEKKSKAVRLIFVIMIIFFLFWTPYNLTILISVFQDFLFTHECEQSRHLDLAVQVTEVIAYTHCCVNPVI
YAFVGERFRKYLRQLFHRRVAVHLVKWLPFLSVDRLDRVSSTSPSTGEHELSAGF

FIGURE 164

```
ACAGAAGTGCTAGAAGCCAGTGCTCGTGAACTAAGGAGAAAAAGAACAGACAAGGGAACAGCCTGGACATGGCAT
CAGAGATCCACATGACAGGCCCAATGTGCCTCATTGAGAACACTAATGGGCGACTGATGGCGAATCCAGAAGCTC
TGAAGATCCTTTCTGCCATTACACAGCCTATGGTGGTGGTGGCAATTGTGGGCCTCTACCGCACAGGCAAATCCT
ACCTGATGAACAAGCTGGCTGGAAAGAAAAAGGGCTTCTCTCTGGGCTCCACGGTGCAGTCTCACACTAAAGGAA
TCTGGATGTGGTGTGTGCCCCACCCCAAGAAGCCAGGCCACATCCTAGTTCTGCTGGACACCGAGGGTCTGGGAG
ATGTAGAGAAGGGTGACAACCAGAATGACTCCTGGATCTTCGCCCTGGCCGTCCTCCTGAGCAGCACCTTCGTGT
ACAATAGCATAGGAACCATCAACCAGCAGGCTATGGACCAACTGTACTATGTGACAGAGCTGACACATAGAATCC
GATCAAAATCCTCACCTGATGAGAATGAGAATGAGGTTGAGGATTCAGCTGACTTTGTGAGCTTCTTCCCAGACT
TTGTGTGGACACTGAGAGATTTCTCCCTGGACTTGGAAGCAGATGGACAACCCCTCACACCAGATGAGTACCTGA
CATACTCCCTGAAGCTGAAGAAAGGTACCAGTCAAAAAGATGAAACTTTTAACCTGCCCAGACTCTGTATCCGGA
AATTCTTCCCAAAGAAAAAATGCTTTGTCTTTGATCGGCCCGTTCACCGCAGGAAGCTTGCCCAGCTCGAGAAAC
TACAAGATGAAGAGCTGGACCCCGAATTTGTGCAACAAGTAGCAGACTTCTGTTCCTACATCTTTAGTAATTCCA
AAACTAAAACTCTTTCAGGAGGCATCCAGGTCAACGGGCCTCGTCTAGAGAGCCTGGTGCTGACCTACGTCAATG
CCATCAGCAGTGGGGATCTGCCGTGCATGGAGAACGCAGTCCTGGCCTTGGCCCAGATAGAGAACTCAGCTGCAG
TGCAAAAGGCTATTGCCCACTATGAACAGCAGATGGGCCAGAAGGTGCAGCTGCCCACAGAAAGCCTCCAGGAGC
TGCTGGACCTGCACAGGGACAGTGAGAGAGAGGCCATTGAAGTCTTCATCAGGAGTTCCTTCAAAGATGTGGACC
ATCTATTTCAAAAGGAGTTAGCGGCCCAGCTAGAAAAAAAGCGGGATGACTTTTGTAAACAGAATCAGGAAGCAT
CATCAGATCGTTGCTCAGGTTTACTTCAGGTCATTTTCAGTCCTCTAGAAGAAGAAGTGAAGGCGGGAATTTATT
CGAAACCAGGGGGCTATCGTCTCTTTGTTCAGAAGCTACAAGACCTGAAGAAAAAGTACTATGAGGAACCGAGGA
AGGGGATACAGGCTGAAGAGATTCTGCAGACATACTTGAAATCCAAGGAGTCTATGACTGATGCAATTCTCCAGA
CAGACCAGACTCTCACAGAAAAAGAAAAGGAGATTGAAGTGGAACGTGTGAAAGCTGAGTCTGCACAGGCTTCAG
CAAAAATGTTGCAGGAAATGCAAAGAAAGAATGAGCAGATGATGGAACAGAAGGAGAGGAGTTATCAGGAACACT
TGAAACAACTGACTGAGAAGATGGAGAACGACAGGGTCCAGTTGCTGAAAGAGCAAGAGAGGACCCTCGCTCTTA
AACTTCAGGAACAGGAGCAACTACTAAAAGAGGGATTTCAAAAAGAAAGCAGAATAATGAAAAATGAGATACAGG
ATCTCCAGACGAAAATGAGACGACGAAAGGCATGTACCATAAGCTAAAGACCAGAGCCTTCCTGTCACCCCTAAC
CAAGGCATAATTGAAACAATTTTAGAATTTGGAACAAGCGTCACTACATTTGATAATAATTAGATCTTGCATCAT
AACACCAAAAGTTTATAAAGGCATGTGGTACAATGATCAAAATCATGTTTTTCTTAAAAAAAAAAAAAGACTG
TAAATTGTGCAACAAAGATGCATTTACCTCTGTATCAACTCAGGAAATCTCATAAGCTGGTACCACTCAGGAGAA
GTTTATTCTTCCAGATGACCAGCAGTAGACAAATGGATACTGAGCAGAGTCTTAGGTAAAAGTCTTGGGAAATAT
TTGGGCATTGGTCTGGCCAAGTCTACAATGTCCCAATATCAAGGACAACCACCCTAGCTTCTTAGTGAAGACAAT
GTACAGTTATCCATTAGATCAAGACTACACGGTCTATGAGCAATAATGTGATTTCTGGACATTGCCCATGTATAA
TCCTCACTGATGATTTCAAGCTAAAGCAAACCACCTTATACAGAGATCTAGAATCTCTTTATGTTCTCCAGAGGA
AGGTGGAAGAAACCATGGGCAGGAGTAGGAATTGAGTGATAAACAATTGGGCTAATGAAGAAAACTTCTCTTATT
GTTCAGTTCATCCAGATTATAACTTCAATGGGACACTTTAGACCATTAGACAATTGACACTGGATTAAACAAATT
CACATAATGCCAAATACACAATGTATTTATAGCAACGTATAATTTGCAAAGATGGACTTAAAAGATGCTGTGTA
ACTAAACTGAAATAATTCAATTACTTATTATTTAGAATGTTAAAGCTTATGATAGTCTTTTCTAATTCTTAACAC
TCATACTTGAAATCTTTCCGAGTTTCCCCAGAAGAGAATATGGGATTTTTTTGACATTTTTGACCCATTTAATA
ATGCTCTTGTGTTTACCTAGTATATGTAGACTTTGTCTTATGTGTCAAAAGTCCTAGGAAAGTGGTTGATGTTTC
TTATAGCAATTAAAAATTATTTTTGAACTGA
```

FIGURE 165

MASEIHMTGPMCLIENTNGRLMANPEALKILSAITQPMVVVAIVGLYRTGKSYLMNKLAGKKKGFSLGSTVQSHT
KGIWMWCVPHPKKPGHILVLLDTEGLGDVEKGDNQNDSWIFALAVLLSSTFVYNSIGTINQQAMDQLYYVTELTH
RIRSKSSPDENENEVEDSADFVSFFPDFVWTLRDFSLDLEADGQPLTPDEYLTYSLKLKKGTSQKDETFNLPRLC
IRKFFPKKKCFVFDRPVHRRKLAQLEKLQDEELDPEFVQQVADFCSYIFSNSKTKTLSGGIQVNGPRLESLVLTY
VNAISSGDLPCMENAVLALAQIENSAAVQKAIAHYEQQMGQKVQLPTESLQELLDLHRDSEREAIEVFIRSSFKD
VDHLFQKELAAQLEKKRDDFCKQNQEASSDRCSGLLQVIFSPLEEEVKAGIYSKPGGYRLFVQKLQDLKKKYYEE
PRKGIQAEEILQTYLKSKESMTDAILQTDQTLTEKEKEIEVERVKAESAQASAKMLQEMQRKNEQMMEQKERSYQ
EHLKQLTEKMENDRVQLLKEQERTLALKLQEQEQLLKEGFQKESRIMKNEIQDLQTKMRRRKACTIS

FIGURE 166

```
TTCCTCAGAAACGAGCAAACCTGAAAGCTACTCTCTCAGCTTCAGAGGGAAAAAATGGTTGTAGATTTCTGGACT
TGGGAGCAGACATTTCAAGAACTAATCCAAGAGGCAAAACCCCGGGCCACATGGACGCTGAAGTTGGATGGCAAC
CTTCAGCTAGACTGCCTGGCTCAAGGGTGGAAGCAATACCAACAGAGAGCATTTGGCTGGTTCCGGTGTTCCTCC
TGCCAGCGAAGTTGGGCTTCCGCCAAGTTGCAGATTCTGTGCCACACGTACTGGGAGCACTGGACATCCCAGGGT
CAGGTGCGTATGAGGCTCTTTGGCCAAAGGTGCCAGAAGTGCTCCTGGTCCCAATATGAGATGCCTGAGTTCTCC
TCGGATAGCACCATGAGGATTCTGAGCAACCTGGTGCAGCATATACTGAAGAAATACTATGGAAATGGCATGAGG
AAGTCTCCAGAAATGCCAGTAATCCTGGAAGTGTCCCTGGAAGGATCCCATGACACAGCCAATTGTGAGGCATGC
ACTTTGGGCATATGTGGACAGGGCTTAAAAAGCTACATGACAAAGCCGTCCAAATCCCTACTCCCCCACCTAAAG
ACTGGGAATTCCTCACCTGGAATTGGTGCTGTGTACCTCGCAAACCAAGCCAAGAACCAGTCAGATGAGGCAAAA
GAGGCTAAGGGGAGTGGGTATGAGAAATTAGGGCCCAGTCGAGACCCAGATCCACTGAACATCTGTGTCTTTATT
TTGCTGCTTGTATTTATTGTAGTCAAATGCTTTACATCAGAATGATGAAAATAGGCTTGCCACTTTCTCTTATTT
TAATTCCATGGTAGTCAATGAACTGGCTGCCACTTTAATATAACTGAAAATTCATTTTGAGACCAAGCAGGATCA
AGTTTGTAGAATAAACACTGGTTTCCTAGCTATCCTCTGAAAACAGTATGAAACATGACCAAGTACATAATGGAT
TTAGTAATAAATATTGTCGAATTGCTAAAAAAAAAAAAA
```

FIGURE 167

```
MVVDFWTWEQTFQELIQEAKPRATWTLKLDGNLQLDCLAQGWKQYQQRAFGWFRCSSCQRSWASAKLQILCHTYW
EHWTSQGQVRMRLFGQRCQKCSWSQYEMPEFSSDSTMRILSNLVQHILKKYYGNGMRKSPEMPVILEVSLEGSHD
TANCEACTLGICGQGLKSYMTKPSKSLLPHLKTGNSSPGIGAVYLANQAKNQSDEAKEAKGSGYEKLGPSRDPDP
LNICVFILLLVFIVVKCFTSE
```

FIGURE 168

```
CTCTGTCCTGCCAGCACCGAGGGCTCATCCATCCACAGAGCAGTGCAGTGGGAGGAGACGCCATGACCTCCATCC
TCACGGTCCTGATCTGTCTCGGGCTGAGCCTGGACCCCAGGACCCACGTGCAGGCAGGGCCCCTCCCCAAGCCCA
CCCTCTGGGCTGAGCCAGGCTCTGTGATCACCCAAGGGAGTCCTGTGACCCTCAGGTGTCAGGGGAGCCTGGAGA
CGCAGGAGTACCATCTATATAGAGAAAAGAAAACAGCACTCTGGATTACACGGATCCCACAGGAGCTTGTGAAGA
AGGGCCAGTTCCCCATCCTATCCATCACCTGGGAACATGCAGGGCGGTATTGCTGTATCTATGGCAGCCACACTG
CAGGCCTCTCAGAGAGCAGTGACCCCCTGGAGCTGGTGGTGACAGGAGCCTACAGCAAACCCACCCTCTCAGCTC
TGCCCAGCCCTGTGGTGACCTCAGGAGGGAATGTGACCATCCAGTGTGACTCACAGGTGGCATTTGATGGCTTCA
TTCTGTGTAAGGAAGGAGAAGATGAACACCCACAATGCCTGAACTCCCATTCCCATGCCCGTGGGTCATCCCGGG
CCATCTTCTCCGTGGGCCCCGTGAGCCCAAGTCGCAGGTGGTCGTACAGGTGCTATGGTTATGACTCGCGCGCTC
CCTATGTGTGGTCTCTACCCAGTGATCTCCTGGGGCTCCTGGTCCCAGGTGTTTCTAAGAAGCCATCACTCTCAG
TGCAGCCGGGTCCTGTCGTGGCCCCTGGGGAGAAGCTGACCTTCCAGTGTGGCTCTGATGCCGGCTACGACAGAT
TTGTTCTGTACAAGGAGTGGGGACGTGACTTCCTCCAGCGCCCTGGCCGGCAGCCCCAGGCTGGGCTCTCCCAGG
CCAACTTCACCCTGGGCCCTGTGAGCCGCTCCTACGGGGGCCAGTACACATGCTCCGGTGCATACAACCTCTCCT
CCGAGTGGTCGGCCCCCAGCGACCCCCTGGACATCCTGATCACAGGACAGATCCGTGCCAGACCCTTCCTCTCCG
TGCGGCCGGGCCCCACAGTGGCCTCAGGAGAGAACGTGACCCTGCTGTGTCAGTCACAGGGAGGGATGCACACTT
TCCTTTTGACCAAGGAGGGGGCAGCTGATTCCCCGCTGCGTCTAAAATCAAAGCGCCAATCTCATAAGTACCAGG
CTGAATTCCCCATGAGTCCTGTGACCTCGGCCCACGCGGGGACCTACAGGTGCTACGGCTCACTCAGCTCCAACC
CCTACCTGCTGACTCACCCCAGTGACCCCCTGGAGCTCGTGGTCTCAGGAGCAGCTGAGACCCTCAGCCCACCAC
AAAACAAGTCCGACTCCAAGGCTGGTGAGTGAGGAGATGCTTGCCGTGATGACGCTGGGCACAGAGGGTCAGGTC
CTGTCAAGAGGAGCTGGGTGTCCTGGGTGGACATTTGAAGAATTATATTCATTCCAACTTGAAGAATTATTCAAC
ACCTTTAACAATGTATATGTGAAGTACTTTATTCTTTCATATTTTAAAAATAAAAGATAATTATCCATGAA
```

FIGURE 169

MTSILTVLICLGLSLDPRTHVQAGPLPKPTLWAEPGSVITQGSPVTLRCQGSLETQEYHLYREKKTALWITRIPQ
ELVKKGQFPILSITWEHAGRYCCIYGSHTAGLSESSDPLELVVTGAYSKPTLSALPSPVVTSGGNVTIQCDSQVA
FDGFILCKEGEDEHPQCLNSHSHARGSSRAIFSVGPVSPSRRWSYRCYGYDSRAPYVWSLPSDLLGLLVPGVSKK
PSLSVQPGPVVAPGEKLTFQCGSDAGYDRFVLYKEWGRDFLQRPGRQPQAGLSQANFTLGPVSRSYGGQYTCSGA
YNLSSEWSAPSDPLDILITGQIRARPFLSVRPGPTVASGENVTLLCQSQGGMHTFLLTKEGAADSPLRLKSKRQS
HKYQAEFPMSPVTSAHAGTYRCYGSLSSNPYLLTHPSDPLELVVSGAAETLSPPQNKSDSKAGE

FIGURE 170

```
GATTCGCCCAGTAGGCATGAGCCACCGCGCCCGGTCGAGGGTTTTCTCATAGTATGTTTAGTTGTTCTGAGGAGC
TTTGTATCTTTGAGAAATGCATGTTTACAACATCCACAGTTTCTTCTAAAGCTTTCAGGTGAACTGCACACAGTT
CCACTATGTCTTCTGGGGAAACTCTTGAATATCCTGGTACATCTTCCTTTATAAGGACTCATACTGGGCCCACTA
TGTAAAACGTGGTTTTTCGGGATATTGGAGGTTTTGCACCACAGAGAATTCAATTCACTTGGGAGTGTTCATCTA
TTTAGGAAGTATAGTTTTTTTTACTTTTGTCTTCAGGAATATGCACTGCTACCTTTTAGAAATAATTTCTATTGC
CTTTATTATTTTTGTTGTTATTTAATGGGAAAAGGTTAGACATGGCCAGGTAAATGTTATCAAATAAAGTTAGTA
TTCGTATTCAACAAGTGGAATTTTTACTTTGCTGTTCTCAGAAACCCATGAATCTGTGTGTTCTCAGAAACCCAT
GAATCATTATGTATACAAATTAAAAATTGTAATGTACTGCT
```

FIGURE 171

DSPSRHEPPRPVEGFLIVCLVVLRSFVSLRNACLQHPQFLLKLSGELHTVPLCLLGKLLNILVHLPL

FIGURE 172

```
GCCGAATAGCCGTGTTTGGGACCTGGGCTCGGGCTTCTTGCGTCCCCGCTAAGAACATGTCACGGGGCCGAATCG
TCCGTATTCTCTCAGCTTCAAGCTCCTCTACTTTTCAACCAGGTCACTAGCCCTTGACTCCTCTTATCAAACTTC
CGGAACTGCCACCCCACCAGTGACTCCACAGGCACCAGGGCATGCAACAGGGCTGGGACAGGAAGGCTCTCTTCT
TCACCTCAAGCCTGCTGGGCTAACACTTGCGATTTTTACTAGAGTTAACTTTGTAATGTATGTCTCTGACTCTAG
AATTTCAAGAGAAGTTCCACTTAGTGACTCCTAAGTGGAAGTTCTAAGATGGCTTCCCAGTGAGGTGATGAAGAG
GTTGAGCTTTAGAGTGCAGTTGCAAAGCTCTTCTCTGACCTGAACAATGGCTGTAGCTGTGGACCAACAAATCC
AGACTCCTTCAGTACAAGATCTCCAAATAGTTAAACTGGAAGAAGATTCCCACTGGGAGCAGGAAATTTCCCTTC
AAGGGAATTACCCTGGACCAGAGACATCCTGCCAGAGCTTTTGGCATTTCCGTTACCAAGAAGCATCACGACCCC
GAGAGGCCCTCCTCCAGCTCCAGAAGCTCTGTTGTCAGTGGCTAAGGCCAGAGAAGTGTACAAAAGAGCAGATCC
TGGAGTTGCTGGTCCTAGAACAGTTCCCGACTGTCCTTCTCCAGGAGATCCAGATCTGGGTCAGACAGCAGCATC
CGGAGAGTGGAGAGGAGGCAGTGGCCCTGGTGGAAGACTTGCAGAAAGAACCTGGAAGACAGAGGCTGGAGCCTC
GGGCGAGGCCGTCCGGCCGCACCCCTCCTGCTCAGCTGCGGTCGCCATGGCCAATGACAGCTGCGGGCCCGGCGA
GCCGAGCTCGAGCGAGCGAGACCGGCAGTACTGCGAGCTGTGCGGGAAGATGGAGAACCTGCTGCGCTGCAGCCG
CAGCTCCTTCTGCTGCAAGGAGCGCCAGCGCCAGGACTGGAAGAAGCACAAGCTCGTGTGCCAGGGCAGCGAGGG
CGCCCTCGGCCACGGAGGGGCCCTCACCAGGACTCCGGCCCCGCGCCGCCCGCTGCAGCGCCGCCGTCCAGGGA
CCGGGCCCTGGAGGCCAGGAAGGCAGCGAGGCGCCGGGACAGCGCCTCCGGGGACGCAGCCAAGGCAAAGGCCAA
GTCCGCGGCCGACCCCGCGGCGGCCGCGTCCCCGCCTCGCGCGTCCCCGGGCCGGACAAAAGCCATGGCTGCTTG
TTATCCGGTCAATGGAACGGGTTATGTACGTCATGTTGATAATCCAAATGGAGACGGAAGACGTGTGAAATGTAT
TACATTACGTTAAAGAACGGGATGCCAAGGTAAGTGGAGGTATACTTCGAATTTTTCTAGAAGGTAAAGCCTAGT
TTGCTGACATTGAACCCAAATTTGATAGACTGCTGTTTTTCTGGTCTGACCATCGCAACCCTCATGAAGTACAAC
CAGCATATGCTACAAAGTACGCAATAACTGTTTGGTATTTGATGCAGATGAGAGAGCACGAGCTAAAGTAAAATA
TCTAACAGGTGAAAAAGGTGTGAGGATTGAACTCAATAAACCTTCAGATTCAGTCAGTAAAGACGTCTTATAGAG
CCTTTGATCCAGCAATACCCCACTTCACCTACAATAATTGTTGACGCTATTTGTTAATTTGTGAATACGAATAAA
TGGGATAAAGAAAAATAGACAACCAGTTCGCATTTTAGTAAGGAAACAAACAACTTTGTGTGTTGCATCAAACAG
AAGATTCTGACTGCTGTGACTTTGTACCGCATGATCAACTTAGAATCTGTGATTGCTTACAGGAAGAAGATAAGC
TACTAATAGAAAATGTTTTTACCTCTGGATATGAAATAAGTGCCCTGTGTAGAATTTTTTTCATTCTTATATTTT
GCCAGATCTGTTACGTAGCTGAGTTAATTTCATCTCTACTTTTTTAATATATGTCAAGTTTGAATTGGAATAATT
TTTCTATGATTAGGTACAATTTATCAAAACTGAATTGAGAAAAAATTACAGTATTTCTCAAAATAACGTCAATCT
ATTTTGTAAACCTCTTCATACTATTAAATTTTGCCCTAAAAGACCTCTTAATAATGATTGTTGCCAGTGACTGA
TTAATTTTATTTTACTTAAAATAAGAAAAGGAGCACTTTAATTACAACTGAAAAATCAGATTGTTTTGCAGTCCT
TCCTATCTTACACTAATTTGAACTCTTAAAGATTGCTGCTTTTTTTGATATTGTCAATAATGAAACCCAATTGT
AAAACAGTCACCATTTACTACCAGTAACTTTTAGTTAATGTCTTACAAGGAAAAAGACACAATAAGAAGAGTTTA
ATTTTTTTTTTTTTTGAGCCTGGGCGACAGAGTGAGACTCCGTCTCAAAAAAAAAAAAAAAAAGAAATGTTTC
ATTTTGGTTTTTCACCAACCTTCCTTTGATAGGACAAAGCAGATACTAAGAGGGGGAGGAAAGGCTGTTCTGTGT
CTGAACCCAGTTGGGCTAGTCCCCAAGAGGAGCTGAGAGCCATGTACTCTAATGCCTCCCTTTTCTTCCCCCAGC
CCTGCCTGATGTGGCTCTGGGAATTCCTGCAGAGAAGAGCAGGGGTGGCCAGGAGATAGTGAGCAGCTCCCAGGA
GGCATGGAGGGATCCAGAACCTGGACTGAAGAACCACCTAGAAATAACTCAGCAGAATTCTGAAAATGAGGTCAC
GCTGGGTAAGAATGCCTTTTTTTTTTTTCATAGTCAAAGTTAGCTATGGAGTTTCTGTAGTATTCACTACTCCA
GACCTTTTCAAGTTGAATTTTTTTCTTTTTCCCTATGTCTGTTCTTACGTATTTTTTTAAACTTTTATTTCA
GTAGTGTTTGGGGAACAAGTAGTGTTTGGTTGCATGGAAAAGTTCTTCAGTGGTGATTTCTGAGATTTTGGTGCA
CCCATCACCCAAGGGTAGTCTTTTTATCCATCAAGTCTGTACCCAATGTGTAGTCTTTGTTTTTTCTTTTTTT
TTTTTTTTGAGACTGAGTCTCATTCTATCACCCAGGCTGGAGTGGAGTGGTATGATCTTGACTCACTGCAACATC
TGCCTCCCGGGTTCAAGTGATTCTCCTGCCTCAGCCTCCTGAGTCGCTGGGATTACTGAGATTGTGCCACTGCAC
TCCAGCCTGGGCGACAGAGTGAGACTCCGTCTC
```

FIGURE 173

MAVAVDQQIQTPSVQDLQIVKLEEDSHWEQEISLQGNYPGPETSCQSFWHFRYQEASRPREALLQLQKLCCQWLR
PEKCTKEQILELLVLEQFPTVLLQEIQIWVRQQHPESGEEAVALVEDLQKEPGRQRLEPRARPSGRTPPAQLRSP
WPMTAAGPASRARASETGSTASCAGRWRTCCAAAAAPSAARSASARTGRSTSSCARAARAPSATEGALTRTPAPR
RPLQRRRPGTGPWRPGRQRGAGTAPPGTQPRQRPSPRPTPRRPRPRLARPRAGQKPWLLVIRSMERVMYVMLIIQ
METEDV

FIGURE 174

TTTTTTGGATTCTGCCAGCTTTATTTTTCAGTTGAAAACTCAAAGGAAAAAGTTACATTCCCAAAAGAAAGTAAA
ACACTTCCAATGATGTAGCCTGGAGGCCTGAGTTCACAGGTGCCCCTACCAAAACAGAGGCCCTCCCCAGGGTCC
CCTAAAGCATTCAGTCCCAGTGTGTCTACCCCAAAGAGAGAAGCTGCCTACCTGGGCTTCTGATTAAGAGGCTTG
GGGCCATCACTTCCCTTCAAGGAAACTCCTGCCTGAAAAGACCCCTGGATCAGGCAGGGAAAGCCAGTACCAAGC
AGCTGAGGACCTGGCTTCGTGTCCCCCACCACGCAGTCAGCGTTCTGAAGCAGTGGCTTCCCAAATGGCTGTTGA
ATAAGTGAATAAATCTCTTGGGCATGAACAGGGGCCAGGTGGAGTTTTCTCTGCAGAGCTGGTACTTGCTGGCCG
CACTGTCTCCTGGTTTGCAGTGGAAGTGTGGAGGAAGGGGGAGAATTACTCAGACCAGTGGGAGAGTTTCATGTC
CCCCGGAAGTATTTTGAGCCCAGTGGCAATGAGCCCTGCTTCCGTGCGTTTGCAGCACGTGCGGTTCTGAGTTTC
CCGGCATTCCATGCTGGTTATTCTGTCCCAGCCATGAATCTTGTCATTGTCAGGGAGCTGGAATTGCAGTAGAAG
GTGAAGGAGTTTGAAGTCTGGCAGCCTAGTGCTGGCATAGACAAAATCTCAAACACACTGTGGAGGAGGGGCCAG
GGGTACGAATCCACGGGCACACAGGTGGATGTAGGCGGCCG

FIGURE 175

FFGFCQLYFSVENSKEKVTFPKESKTLPMM

FIGURE 176

```
TATATATCGTGATATAGAACCCTATATCTTATCTCAGTTCTTTTATGTTATCTCCAAATGAATTACTAAGACAAA
GGGATAATAAATGGGAAGTGTACAACCCGGAGGACTTCAGACCAGAAAATCAAAGAGAGATGATGGGAAAGGGTG
GAGTAATGCTGAGTTTTGAAGAATGGGCACATTTAGACAGACCAAAGACTGAGCATCATATCATTGCTGCCGTTC
CATGAACTGAGAGCAAACTGTTAGATCATGACCTGCTACAGAATCACTAGGCATCAGGAAGAAGAGTAGGTATAT
GGTCTGTATTAGAGTATAGCAATGGATTATTCTTCCAGCTGCCAAGAAGTCAAGAAGGAAAGCCTGTATTTGACT
TTATCATTTCTATTGAATGTCTGAGTGATACATAGAGTAGTAATTTTAGACATTTAAGTAACTAAAGATTTATAT
AGCTTTAGTATGTAAGCTGTTATATTTAAAAATGCTTGAAAAAATAAGAGTTGTTCTCCAGAAATTATTCATTTT
CCTATGATTAGCACAGCTGAGACCTTACAGGTGCACTGCTATTGAGTATTCTCCCAACCTTTTAAATTTTATAGG
TCTAATTGTTGGTAAGGTATTGTGGAAGGAGTTCTAAGACTTGCTCCTGCTTTAATTGACGTTGCAATAATAATC
ATAATAAAATTGTTGGTCAAAGAGTAGCACAGGAGTGGTTTTGGTAGTGAAGAAAATAAAAAGAAATCTGAAGGT
AGAGATGAATGGAATCAGCAAAAGTGAAATTGGTTAGATTAGTAAGTTGTTTTTCTACTGGGACACTCATGGATG
ATACTGACATATACTCCATTCTCCCTTGCTAATATCTAGATTTTTTAGTACCTCTAATACTAAGAGATTTTTAA
TTTCTTTGCTATACTTCTGTCCTTTTCTTCTCTATTCATGCTCAAAAGAAAGTAAGTGCTATAACTACTCTTTTT
TGTTTGCTTAAAAAATGACTCATGAACTTAAGGTACTTAAGTATGGACACTCCTGACAACTAATACCATAGCGGA
GAACTACTGAGTTAAAGGGTACCAGTGCAAATAGAGGGCTGAAAACAAGGAAGGTCAGTCAGTGAATGGGAAAGA
AATATGACAAAGCCTAGGAAAGGGAGCTCCTCTAGCATCAAACTGTCTGCATGTCGAGTCTCAGAAAAACAAGGA
TTCGTCAGTCAACCCCTTTCTGCATGCACAGTGGATTTAGGGTAAAGTTTATGTTACCCTGTCT
```

FIGURE 177

MSSLRKTRIRQSTPFCMHSGFRVKFMLPC

FIGURE 178

```
GGCACTGGAGCGAACACTGGGCAGATTCCCCCCGACATCATTTAGACGTGTGCCTTTATTCAGTACCAGGGTACC
AGGGCCGGCCTGGGTGCCAGGTAGGGAGGCAGGAGCAAGAAAGTGGAGGCTCCCCTGGCAGAGGTTCCCTCTGGA
AGGAGCATGGCTTGTTGGGACTGGAGGCCAGAGGCTGGGGAGGCTTCCTGAGGGAGGTGAGGGGAAAGCATTGGA
TGAGAAGGAGCTGATTGAGAAAATGAATCTGTCTGCCATCCAGGACCGAGAGATCTGCTGCTACTCCATCTCTTG
CAAAGAAAAGGACAACATTGACATCACCCTACAGTGGCTTATTCAACACTCGAAGTCACGGAGAAGCTGAGACTC
CAGCCCTTCTCCCTCAGACCAGGGACCGTCATCATCTAAACCTGAAGCCGAGCTCCCCGCCCACCCCTGTCGTCC
CCCTAAGCCCACCCCTCCTCACCCAGTGTGAGGAGGGCCCTCTGGGGACCCCAGAGTCCTGTTCTGCTGAGGTTT
GAACTCCTGTTTTTATTGTAAAATAAATTGCCCCCCATTCTGGTCCCCTAACTTCTCACCCTTCCCCGCTGCCTT
TGTCCCATCACCCAGCCCTGCCTCCCTCCCAGCAGCCCTGGGCCACAGCCCCCGCCCCTGGCTTTTCCCCGGCCC
GCTCTTGTACCTCCCTTTTCAACACTCTCTGTTATTGTCCTGTGTGTACAGTATATATATGTATATATATTTTAA
TTTTTAATTTAAGCAAAGACTAAAATCAACCATTTGATGCTGCAGGGGCCTTTCAGGATCTGGGAGGGGGCAGT
CTGGAGAGAAGGAGGGAGACGCAGGTGGACTTGGGGCAAGTTCAGATCAGAAGAGGTGCAGGCTGGCACCTGCGG
CAGGTACCAGCCTGGGCACTGGTGGCCGCCTCCCTGTCCCGTGTGTTTCCACCGCCCAATCGGCTTGTCCTGGC
AGTGCTTGAATGCCACAGGCTGGCAGGGGCCTCTGGGGGCCCCTCCCCTCGACCCCCAGCCTGGGTAGAGCCAC
CAGGTACGACGACCAGGTACCAGAAACCACCAGGCACACGGGGCAGAAAGCAGCGTCATG
```

FIGURE 179

MLQGPFRIWEGAVWREGGRRRWTWGKFRSEEVQAGTCGRYQPGHWWPPPCPVCFHRPIWLVLAVLECHRLAGASG
GPLPSTPSLGRATRYDDQVPETTRHTGQKAAS

FIGURE 180

```
GGGGGTTTTTGCTAGAAAAGCACTCCTGGAGCTTGCCACCAGCTTGGACTTCTAGGGACTTTCCTCTCAGCCAGG
AAGGATTTTGATATTCATCAGAAATACCTCCAGAAGATTCAAGGAGCTGTAGAGGTGAAGTAAGCCTGTGAAGGA
CCAGCATGGGAATCCTATACTCTGAGCCCATCTGCCAAGCAGCCTATCAGAATGACTTTGGACAAGTGTGGCGGT
GGGTGAAAGAAGACAGCAGCTATGCCAACGTTCAAGATGGCTTTAATGGAGACACGCCCCTGATCTGTGCTTGCA
GGCGAGGGCATGTGAGAATCGTTTCCTTCCTTTTAAGAAGAAATGCTAATGTCAACCTCAAAAACCAGAAAGAGA
GAACCTGCTTGCATCATGCTGTGAAGAAAAAATTTACCTTCATTGATTATCTACTAATTATCCTCTTAATGCCTG
TTCTGCTTATTGGGTATTTCCTCATGGTATCAAAGACAAAGCAGAATGAGGCTCTTGTACGAATGCTACTTGATG
CTGGTGTCGAAGTTAATGCTACAGATTGTTATGGCTGTACCGCATTACATTATGCCTGTGAAATGAAAAACCAGT
CTCTTATCCCTCTGCTCTTGGAAGCCCGTGCAGACCCCACAATAAAGAATAAGCATGGTGAGAGCTCACTGGATA
TTGCACGGAGATTAAAATTTCCCAGATTGAATTAATGCTAAGGAAAGCATTGTAATCCTTGTGACCACACCGAT
GGAGATACAGAAAAAGTTAACGACTGGATTCTATCTTCATTTTAGACTTTTGGTCTGTGGGCCATTTAACCTGGA
TGCCACCATTTTATGGGGATAATGATGCTTACCATGGTTAATGTTTTGGAAGAGCTTTTTATTTATAGCATTGTT
TACTCAGTCAAGTTCACCATGGCCGTAATCCTTCTAAGGGAAACACTAAAGTTGTTGTAGTCTCCACTTCAGTCA
GAAACTGATGTTTCAGCTAGGCACAGTGGTACATGCCTGTAATCCCAGCTACTTGGGAGGCTGAGGTGGGAGGAT
CACTTGAACTCAGGAGTTTGAGAGCAGCCAGGGCAACACAGCGAGACCCTGTCCCAAAAAAAAAAAAAAAAAAAA
AAAAAAAAAA
```

FIGURE 181

MGILYSEPICQAAYQNDFGQVWRWVKEDSSYANVQDGFNGDTPLICACRRGHVRIVSFLLRRNANVNLKNQKERT
CLHHAVKKKFTFIDYLLIILLMPVLLIGYFLMVSKTKQNEALVRMLLDAGVEVNATDCYGCTALHYACEMKNQSL
IPLLLEARADPTIKNKHGESSLDIARRLKFSQIELMLRKAL

FIGURE 182A

ATGGGCTTCTTGCCCAAGCTTCTCCTCCTGGCCTCATTCTTCCCAGCAGGCCAGGCCTCATGGGCGTCTCCAGT
CCCCAGGACGTGCAGGGTGTGAAGGGGTCTTGCCTGCTTATCCCCTGCATCTTCAGCTTCCCTGCCGACGTGGAG
GTGCCCGACGGCATCACGGCCATCTGGTACTACGACTACTCGGGCCAGCGGCAGGTGGTGAGCCACTCGGCGGAC
CCCAAGCTGGTGGAGGCCCGCTTCCGCGGCCGCACCGAGTTCATGGGGAACCCCGAGCACAGGGTGTGCAACCTG
CTGCTGAAGGACCTGCAGCCCGAGGACTCTGGTTCCTACAACTTCCGCTTCGAGATCAGTGAGGTCAACCGCTGG
TCAGATGTGAAAGGCACCTTGGTCACAGTAACAGAGGAGCCCAGGGTGCCCACCATTGCCTCCCCGGTGGAGCTT
CTCGAGGGCACAGAGGTGGACTTCAACTGCTCCACTCCCTACGTATGCCTGCAGGAGCAGGTCAGACTGCAGTGG
CAAGGCCAGGACCCTGCTCGCTCTGTCACCTTCAACAGCCAGAAGTTTGAGCCCACCGGCGTCGGCCACCTGGAG
ACCCTCCACATGGCCATGTCCTGGCAGGACCACGGCCGGATCCTGCGCTGCCAGCTCTCCGTGGCCAATCACAGG
GCTCAGAGCGAGATTCACCTCCAAGTGAAGTATGCCCCCAAGGGTGTGAAGATCCTCCTCAGCCCCTCGGGGAGG
AACATCCTTCCAGGTGAGCTGGTCACACTCACCTGCCAGGTGAACAGCAGCTACCCTGCAGTCAGTTCCATTAAG
TGGCTCAAGGATGGGGTACGCCTCCAAACCAAGACTGGTGTGCTGCACCTGCCCCAGGCAGCCTGGAGCGATGCT
GGCGTCTACACCTGCCAAGCTGAGAACGGCGTGGGCTCTTTGGTCTCACCCCCCATCAGCCTCCACATCTTCATG
GCTGAGGTCCAGGTGAGCCCAGCAGGTCCCATCCTGGAGAACCAGACAGTGACACTAGTCTGCAACACACCCAAT
GAGGCACCCAGTGATCTCCGCTACAGCTGGTACAAGAACCATGTCCTGCTGGAGGATGCCCACTCCCATACCCTC
CGGCTGCACTTGGCCACTAGGGCTGATACTGGCTTCTACTTCTGTGAGGTGCAGAACGTCCATGGCAGCGAGCGC
TCGGGCCCTGTCAGCGTGGTAGTCAACCACCCGCCTCTCACTCCAGTCCTGACAGCCTTCCTGGAGACCCAGGCG
GGACTTGTGGGCATCCTTCACTGCTCTGTGGTCAGTGAGCCCCTGGCCACACTGGTGCTGTCACATGGGGGTCAT
ATCCTGGCCTCCACCTCCGGGGACAGTGATCACAGCCCACGCTTCAGTGGTACCTCTGGTCCCAACTCCCTGCGC
CTGGAGATCCGAGACCTGGAGGAAACTGACAGTGGGGAGTACAAGTGCTCAGCCACCAACTCCCTTGGAAATGCA
ACCTCCACCCTGGACTTCCATGCCAATGCCGCCCGTCTCCTCATCAGCCCGGCAGCCGAGGTGGTGGAAGGACAG
GCAGTGACACTGAGCTGCAGAAGCGGCCTAAGCCCCACACCTGATGCCCGCTTCTCCTGGTACCTGAATGGAGCC
CTGCTTCACGAGGGTCCCGGCAGCAGCCTCCTGCTCCCCGCGGCCTCCAGCACTGACGCCGGCTCATACCACTGC
CGGGCCCGGGACGGCCACAGTGCCAGTGGCCCCTCTTCGCCAGCTGTTCTCACTGTGCTCTACCCCCTCGACAA
CCAACATTCACCACCAGGCTGGACCTTGATGCCGCTGGGCCGGGGCTGGACGGCGAGGCCTCCTTTTGTGCCGT
GTGGACAGCGACCCCCCCGCCAGGCTGCAGCTGCTCCACAAGGACCGTGTTGTGGCCACTTCCCTGCCATCAGGG
GGTGGCTGCAGCACCTGTGGGGCTGTTCCCCACGCATGAAGGTCACCAAAGCCCCCAACTTGCTGCGTGTGGAG
ATTCACAACCCTTTGCTGGAAGAGGAGGGCTTGTACCTCTGTGAGGCCAGCAATGCCCTGGGCAACGCCTCCACC
TCAGCCACCTTCAATGGCCAGGCCACTGTCCTGGCCATTGCACCATCACACACACTTCAGGAGGGCACAGAAGCC
AACTTGACTTGCAACGTGAGCCGGGAAGCTGCTGGCAGCCCTGCTAACTTCTCCTGGTTCCGAAATGGGGTGCTG
TGGGCCCAGGGTCCCCTGGAGACCGTGACACTGCTGCCCGTGGCCAGAACTGATGCTGCCCTTTACGCCTGCCGC
ATCCTGACTGAGGCTGGTGCCCAGCTCTCCACTCCCGTGCTCCTGAGTGTACTCTATCCCCCGGACCGTCCAAAG
CTGTCAGCCCTCCTAGACATGGGCCAGGGCCACATGGCTCTGTTCATCTGCACTGTGGACAGCCGCCCCTGGCC
TTGCTGGCCTTGTTCCATGGGGAGCACCTCCTGGCCACCAGCCTGGGTCCCCAGGTCCCATCCCATGGTCGGTTC
CAGGCTAAAGCTGAGGCCAACTCCCTGAAGTTAGAGGTCCGAGAACTGGGCCTTGGGGACTCTGGCAGCTACCGC
TGTGAGGCCACAAATGTTCTTGGATCATCCAACACCTCACTCTTCTTCCAGGTCCGAGGAGCCTGGGTCCAGGTG
TCACCATCACCTGAGCTCCAAGAGGGCCAGGCTGTGGTCCTGAGCTGCCAGGTACACACAGGAGTCCCAGAGGGG
ACCTCATATCGTTGGTATCGGGATGGCCAGCCCCTCCAGGAGTCGACCTCGGCCACGCTCCGCTTTGCAGCCATA
ACTTTGACACAAGCTGGGGCCTATCATTGCCAAGCCCAGGCCCCAGGCTCAGCCACCACGAGCCTAGCTGCACCC
ATCAGCCTCCACGTGTCCTATGCCCCACGCCACGTCACACTCACTACCCTGATGGACACAGGCCCTGGACGACTG
GGCCTCCTCCTGTGCCGTGTGGACAGTGACCCTCCGGCCCAGCTGCGGCTGCTCCACGGGGATCGCCTTGTGGCC
TCCACCCTACAAGGTGTGGGGGACCCGAAGGCAGCTCTCCCAGGCTGCATGTGGCTGTGGCCCCCAACACACTG
CGTCTGGAGATCCACGGGGCTATGCTGGAGGATGAGGGTGTCTATATCTGTGAGGCCTCCAACACCCTGGGCCAG
GCCTCGGCCTCAGCTGACTTCGACGCTCAAGCTGTGAATGTGCAGGTGTGGCCCGGGGCTACCGTGCGGGAGGGG
CAGCTGGTGAACCTGACCTGCCTTGTGTGGACCACTCACCCGGCCCAGCTCACCTACACATGGTACCAGGATGGG
CAGCAGCGCCTGGATGCCCACTCCATCCCCCTGCCCAACGTCACAGTCAGGGATGCCACCTCCTACCGCTGCGGT
GTGGGCCCCCTGGTCGGGCACCCCGCCTCTCCAGACCTATCACCTTGGACGTCCTCTACGCGCCCCGCAACCTG
CGCCTGACCTACCTCCTGGAGAGCCATGGCGGGCAGCTGGCCCTGGTACTGTGCACTGTGGACAGCCGCCCGCCC

FIGURE 182B

```
GCCCAGCTGGCCCTCAGCCACGCCGGTCGCCTCTTGGCCTCCTCGACAGCAGCCTCTGTCCCCAACACCCTGCGC
CTGGAGCTGCGAGGGCCACAGCCCAGGGATGAGGGTTTCTACAGCTGCTCTGCCCGCAGCCCTCTGGGCCAGGCC
AACACGTCCCTGGAGCTGCGGCTGGAGGGTGTGCGGGTGATCCTGGCTCCGGAGGCTGCCGTGCCTGAAGGTGCC
CCCATCACAGTGACCTGTGCGGACCCTGCTGCCCACGCACCCACACTCTATACTTGGTACCACAACGGTCGTTGG
CTGCAGGAGGGTCCAGCTGCCTCACTCTCATTCCTGGTGGCCACGCGGGCTCATGCAGGCGCCTACTCTTGCCAG
GCCCAGGATGCCCAGGGCACCCGCAGCTCCCGTCCTGCTGCCCTGCAAGTCCTCTATGCCCCTCAGGACGCTGTC
CTGTCCTCCTTCCGGGACTCCAGGGCCAGATCCATGGCTGTGATACAGTGCACTGTGGACAGTGAGCCACCTGCT
GAGCTGGCCCTATCTCATGATGGCAAGGTGCTGGCCACGAGCAGCGGGGTCCACAGCTTGGCATCAGGGACAGGC
CATGTCCAGGTGGCCCGAAACGCCCTACGGCTGCAGGTGCAAGATGTGCCTGCAGGTGATGACACCTATGTTTGC
ACAGCCCAAAACTTGCTGGGCTCAATCAGCACCATCGGGCGGTTGCAGGTAGAAGGTGCACGCGTGGTGGCAGAG
CCTGGCCTGGACGTGCCTGAGGGCGCTGCCCTGAACCTCAGCTGCCGCCTCCTGGGTGGCCCTGGGCCTGTGGGC
AACTCCACCTTTGCATGGTTCTGGAATGACCGGCGGCTGCACGCGGAGCCTGTGCCCACTCTCGCCTTCACCCAC
GTGGCTCGTGCTCAAGCTGGGATGTACCACTGCCTGGCTGAGCTCCCCACTGGGGCTGCTGCCTCTGCTCCAGTC
ATGCTCCGTGTGCTCTACCCTCCCAAGACGCCCACCATGATGGTCTTCGTGGAGCCTGAGGGTGGCCTCCGGGGC
ATCCTGGATTGCCGAGTGGACAGCGAGCCGCTCGCCAGCCTGACTCTCCACCTTGGCAGTCGACTGGTGGCCTCC
AGTCAGCCCCAGGGTGCTCCTGCAGAGCCACACATCCATGTCCTGGCTTCCCCCAATGCCCTGAGGGTGGACATC
GAGGCGCTGAGGCCCAGCGACCAAGGGGAATACATCTGTTCTGCCTCAAATGTCCTGGGCTCTGCCTCTACCTCC
ACCTACTTTGGGGTCAGAGCCCTGCACCGCCTGCATCAGTTCCAGCAGCTGCTCTGGGTCCTGGGACTGCTGGTG
GGCCTCCTGCTCCTGCTGTTGGGCCTGGGGGCCTGCTACACCTGGAGAAGGAGGCGTGTTTGTAAGCAGAGCATG
GGCGAGAATTCGGTGGAGATGGCTTTTCAGAAAGAGACCACGCAGCTCATTGATCCTGATGCAGCCACATGTGAG
ACCTCAACCTGTGCCCCACCCCTGGGCTGA
```

FIGURE 183

```
MGFLPKLLLLASFFPAGQASWGVSSPQDVQGVKGSCLLIPCIFSFPADVEVPDGITAIWYYDYSGQRQVVSHSAD
PKLVEARFRGRTEFMGNPEHRVCNLLLKDLQPEDSGSYNFRFEISEVNRWSDVKGTLVTVTEEPRVPTIASPVEL
LEGTEVDFNCSTPYVCLQEQVRLQWQGQDPARSVTFNSQKFEPTGVGHLETLHMAMSWQDHGRILRCQLSVANHR
AQSEIHLQVKYAPKGVKILLSPSGRNILPGELVTLTCQVNSSYPAVSSIKWLKDGVRLQTKTGVLHLPQAAWSDA
GVYTCQAENGVGSLVSPPISLHIFMAEVQVSPAGPILENQTVTLVCNTPNEAPSDLRYSWYKNHVLLEDAHSHTL
RLHLATRADTGFYFCEVQNVHGSERSGPVSVVVNHPPLTPVLTAFLETQAGLVGILHCSVVSEPLATLVLSHGGH
ILASTSGDSDHSPRFSGTSGPNSLRLEIRDLEETDSGEYKCSATNSLGNATSTLDFHANAARLLISPAAEVVEGQ
AVTLSCRSGLSPTPDARFSWYLNGALLHEGPGSSLLLPAASSTDAGSYHCRARDGHSASGPSSPAVLTVLYPPRQ
PTFTTRLDLDAAGAGAGRRGLLLCRVDSDPPARLQLLHKDRVVATSLPSGGGCSTCGGCSPRMKVTKAPNLLRVE
IHNPLLEEEGLYLCEASNALGNASTSATFNGQATVLAIAPSHTLQEGTEANLTCNVSREAAGSPANFSWFRNGVL
WAQGPLETVTLLPVARTDAALYACRILTEAGAQLSTPVLLSVLYPPDRPKLSALLDMGQGHMALFICTVDSRPLA
LLALFHGEHLLATSLGPQVPSHGRFQAKAEANSLKLEVRELGLGDSGSYRCEATNVLGSSNTSLFFQVRGAWVQV
SPSPELQEGQAVVLSCQVHTGVPEGTSYRWYRDGQPLQESTSATLRFAAITLTQAGAYHCQAQAPGSATTSLAAP
ISLHVSYAPRHVTLTTLMDTGPGRLGLLLCRVDSDPPAQLRLLHGDRLVASTLQGVGGPEGSSPRLHVAVAPNTL
RLEIHGAMLEDEGVYICEASNTLGQASASADFDAQAVNVQVWPGATVREGQLVNLTCLVWTTHPAQLTYTWYQDG
QQRLDAHSIPLPNVTVRDATSYRCGVGPPGRAPRLSRPITLDVLYAPRNLRLTYLLESHGGQLALVLCTVDSRPP
AQLALSHAGRLLASSTAASVPNTLRLELRGPQPRDEGFYSCSARSPLGQANTSLELRLEGVRVILAPEAAVPEGA
PITVTCADPAAHAPTLYTWYHNGRWLQEGPAASLSFLVATRAHAGAYSCQAQDAQGTRSSRPAALQVLYAPQDAV
LSSFRDSRARSMAVIQCTVDSEPPAELALSHDGKVLATSSGVHSLASGTGHVQVARNALRLQVQDVPAGDDTYVC
TAQNLLGSISTIGRLQVEGARVVAEPGLDVPEGAALNLSCRLLGGPGPVGNSTFAWFWNDRRLHAEPVPTLAFTH
VARAQAGMYHCLAELPTGAAASAPVMLRVLYPPKTPTMMVFVEPEGGLRGILDCRVDSEPLASLTLHLGSRLVAS
SQPQGAPAEPHIHVLASPNALRVDIEALRPSDQGEYICSASNVLGSASTSTYFGVRALHRLHQFQQLLWVLGLLV
GLLLLLLGLGACYTWRRRRVCKQSMGENSVEMAFQKETTQLIDPDAATCETSTCAPPLG
```

FIGURE 184

```
AGCAGAGCACACAAGCTTCTAGGACAAGAGCCAGGAAGAAACCACCGGAAGGAACCATCTCACTGTGTGTAAACA
TGACTTCCAAGCTGGCCGTGGCTCTCTTGGCAGCCTTCCTGATTTCTGCAGCTCTGTGTGAAGGTGCAGTTTTGC
CAAGGAGTGCTAAAGAACTTAGATGTCAGTGCATAAAGACATACTCCAAACCTTTCCACCCCAAATTTATCAAAG
AACTGAGAGTGATTGAGAGTGGACCACACTGCGCCAACACAGAAATTATTGTAAAGCTTTCTGATGGAAGAGC
TCTGTCTGGACCCCAAGGAAAACTGGGTGCAGAGGGTTGTGGAGAAGTTTTTGAAGAGGGCTGAGAATTCATAAA
AAAATTCATTCTCTGTGGTATCCAAGAATCAGTGAAGATGCCAGTGAAACTTCAAGCAAATCTACTTCAACACTT
CATGTATTGTGTGGGTCTGTTGTAGGGTTGCCAGATGCAATACAAGATTCCTGGTTAAATTTGAATTTCAGTAAA
CAATGAATAGTTTTTCATTGTACCATGAAATATCCAGAACATACTTATATGTAAAGTATTATTTATTTGAATCTA
CAAAAAACAACAAATAATTTTTAAATATAAGGATTTTCCTAGATATTGCACGGGAGAATATACAAATAGCAAAAT
TGAGCCAAGGGCCAAGAGAATATCCGAACTTTAATTTCAGGAATTGAATGGGTTTGCTAGAATGTGATATTTGAA
GCATCACATAAAAATGATGGGACAATAAATTTTGCCATAAAGTCAAATTTAGCTGGAAATCCTGGATTTTTTTCT
GTTAAATCTGGCAACCCTAGTCTGCTAGCCAGGATCCACAAGTCCTTGTTCCACTGTGCCTTGGTTTCTCCTTTA
TTTCTAAGTGGAAAAAGTATTAGCCACCATCTTACCTCACAGTGATGTTGTGAGGACATGTGGAAGCACTTTAAG
TTTTTTCATCATAACATAAATTATTTTCAAGTGTAACTTATTAACCTATTTATTATTTATGTATTTATTTAAGCA
TCAAATATTTGTGCAAGAATTTGGAAAAATAGAAGATGAATCATTGATTGAATAGTTATAAAGATGTTATAGTAA
ATTTATTTTATTTTAGATATTAAATGATGTTTTATTAGATAAATTTCAATCAGGGTTTTTAGATTAAACAAAGAA
ACAATTGGGTACCCAGTTAAATTTTCATTTCAGATAAACAACAAATAATTTTTTAGTATAAGTACATTATTGTTT
ATCTGAAAGTTTTAATTGAACTAACAATCCTAGTTTGATACTCCCAGTCTTGTCATTGCCAGCTGTGTTGGTAGT
GCTGTGTTGAATTACGGAATAATGAGTTAGAACTATTAAAACAGCCAAAACTCCACAGTCAATATTAGTAATTTC
TTGCTGGTTGAAACTTGTTTATTATGTACAAATAGATTCTTATAATATTATTTAAATGACTGCATTTTTAAATAC
AAGGCTTTATATTTTTAACTTTAAGATGTTTTATGTGCTCTCCAAATTTTTTTTACTGTTTCTGATTGTATGGA
AATATAAAAGTAAATATGAAACATTTAAAATATAATTTGTTGTCAAAGTAAAAAAAAAAAAAAA
```

FIGURE 185

MTSKLAVALLAAFLISAALCEGAVLPRSAKELRCQCIKTYSKPFHPKFIKELRVIESGPHCANTEIIVKLSDGRE
LCLDPKENWVQRVVEKFLKRAENS

FIGURE 186

```
GGAACCGCCGCCGGTATCCGCGTCCGCAGCGCCGCCAGCCAGGCGAGAGCCGTGTGGGATCCCAGCGCCCGCACT
CCCGCCCCCGCCAAGGAGCCAGGAATGGCACAACTAGAGAGGAGCGCCATCTCTGGCTTCAGCTCTAAGTCCAGG
CGAAACTCATTCGCATATGATGTTAAGCGTGAAGTATACAATGAGGAGACCTTTCAACAGGAACACAAAAGGAAG
GCCTCCTCTTCTGGGAACATGAACATCAACATCACCACCTTCAGACACCACGTCCAGTGCCGCTGCTCATGGCAC
AGGTTCCTACGATGCGTGCTTACAATCTTTCCCTTCCTAGAATGGATGTGTATGTATCGATTAAAGGATTGGCTT
CTGGGAGACTTACTTGCTGGTATAAGTGTTGGCCTTGTGCAAGTTCCCCAAGGCCTGACACTTAGTTTGCTGGCA
AGGCAACTGATTCCTCCTCTCAACATCGCTTATGCAGCTTTCTGTTCTTCGGTAATCTATGTAATTTTTGGATCG
TGTCATCAAATGTCCATTGGTTCCTTCTTCCTGGTGAGTGCTCTGCTGATCAACGTTCTGAAAGTGAGCCCATTC
AACAACGGTCAACTGGTCATGGGATCTTTCGTCAAGAATGAGTTTTCGGCCCCCTCCTACCTTATGGGCTATAAT
AAATCCTTGAGTGTGGTGGCAACCACAACTTTTCTGACTGGGATTATTCAGCTAATAATGGGCGTATTGGGTTTG
GGCTTCATTGCCACTTACCTTCCGGAGTCTGCAATGAGTGCTTACCTGGCTGCTGTGGCACTTCATATCATGCTG
TCCCAGCTGACTTTCATCTTTGGGATTATGATTAGTTTCCATGCCGGTCCCATCTCCTTCTTCTATGACATAATT
AATTACTGTGTAGCTCTCCCAAAAGCGAATTCCACCAGCATTCTAGTATTTCTAACTGTTGTTGTTGCTCTGCGA
ATCAACAAATGTATCAGAATTTCTTTCAATCAGTATCCCATTGAGTTTCCCATGGAATTATTTCTGATTATTGGC
TTCACTGTGATTGCAAACAAGATAAGCATGGCCACAGAAACCAGCCAGACGCTTATTGACATGATTCCTTATAGC
TTTCTGCTTCCTGTAACACCAGATTTCAGCCTTCTTCCCAAGATAATTTTACAAGCCTTCTCCTTATCTTTGGTG
AGCTCCTTTCTGCTCATATTTCTGGGCAAGAAGATTGCCAGTCTTCACAATTACAGTGTCAATTCCAACCAGGAT
TTAATAGCCATCGGCCTTTGCAATGTCGTCAGTTCATTTTTCAGATCTTGTGTGTTTACTGGTGCTATTGCTAGG
ACTATTATCCAGGATAAATCTGGAGGAAGACAACAGTTTGCATCTCTGGTAGGCGCAGGTGTGATGCTGCTCCTG
ATGGTGAAGATGGGACACTTTTCTACACACTGCCAAATGCTGTGCTGGCTGGTATTATTCTGAGCAACGTCATT
CCCTACCTTGAAACCATTTCTAACCTACCCAGCCTGTGGAGGCAGGACCAATATGACTGTGCTCTTTGGATGATG
ACATTCTCATCTTCAATTTTCCTGGGACTGGACATTGGACTAATTATCTCAGTAGTTTCTGCTTTCTTCATCACC
ACTGTTCGTTCACACAGAGCTAAGATTCTTCTCCTGGGTCAAATCCCTAACACCAACATTTATAGAAGCATCAAT
GATTATCGGGAGATCATCACCATTCCTGGGGTGAAAATCTTCCAGTGCTGCAGCTCAATTACATTTGTAAATGTT
TACTACCTAAAGCATAAGCTGTTAAAAGAGGTTGATATGGTAAAGGTGCCTCTTAAAGAAGAAGAAATTTTCAGC
TTGTTTAATTCAAGTGACACCAATCTACAAGGAGGAAAGATTTGCAGGTGTTTCTGCAACTGTGATGATCTGGAG
CCGCTGCCCAGGATTCTTTACACAGAGCGATTTGAAAATAAACTGGATCCCGAAGCATCCTCCATTAACCTGATT
CACTGCTCACATTTTGAGAGCATGAACACAAGCCAAACTGCATCCGAAGACCAAGTGCCATACACAGTATCGTCC
GTGTCTCAGAAAAATCAAGGGCAACAGTATGAGGAGGTGGAGGAAGTTTGGCTTCCTAATAACTCATCAAGAAAC
AGCTCACCAGGACTGCCTGATGTGGCGGAAAGCCAGGGGAGGAGATCACTCATCCCTTACTCAGATGCGTCTCTA
CTGCCCAGTGTCCACACCATCATCCTGGATTTCTCCATGGTACACTACGTGGATTCACGGGGGTTAGTCGTATTA
AGACAGATATGCAATGCCTTTCAAAACGCCAACATTTTGATACTCATTGCAGGGTGTCACTCTTCCATAGTCAGG
GCATTTGAGAGGAATGATTCTTTGACGCTGGCATCACCAAGACCCAGCTGTTCCTCAGCGTTCACGACGCCGTG
CTGTTTGCCTTGTCAAGGAAGGTCATAGGCTCCTCTGAGTTAAGCATCGATGAATCCGAGACAGTGATACGGGAA
ACCTACTCAGAAACAGACAAGAATGACAATTCAAGATATAAAATGAGCAGCAGTTTTCTAGGAAGCCAAAAAAAT
GTAAGTCCAGGCTTCATCAAGATCCAACAGCCTGTAGAAGAGGAGTCGGAGTTGGATTTGGAGCTGGAATCAGAA
CAAGAGGCTGGGCTGGGTCTGGACCTAGACCTGGATCGGGAGCTGGAGCCTGAAATGGAGCCCAAGGCTGAGACC
GAGACCAAGACCCAGACCGAGATGGAGCCCCAGCCTGAGACTGAGCCTGAGATGGAGCCCAACCCCAAATCTAGG
CCAAGAGCTCACACTTTTCCTCAGCAGCGTTACTGGCCTATGTATCATCCGTCTATGGCTTCCACCCAGTCTCAG
ACTCAGACTCGGACATGGTCAGTGGAGAGGAGACGCCATCCTATGGATTCATACTCACCAGAGGGCAACAGCAAT
GAAGATGTCTAGGAGATGAACTAGAAATAAGGGGTCAGATAATGCTGGCAAATCCTCCTACCCAAAAAGGGGTCA
ATTGTCCAGAGACCTAGACTGGATACGAACTAGCAGTACTTCCTTCCTGACTGTGACTCCTACTACCTGCCAGCC
TTCTTCCTTGCTCTGCGCTGGGATCATACTCCCAAATCACATTACTAAATGCCAACAATTATCTCTGAATTCCCT
ATCCAGGCTCCCCTCATTTCACCTTCAGCATATATTCTAGTCATGAATTTCCTTCTTCACACACCCCACATCTCT
GGGCTTTGTGCCAGACCATCTCTAACTTAATCCTCTCATCCCTGTTCCCCTTTCTCCAAAGAGATGAAGCTCAAA
TAAAATGTATAACTCTAGTAAAAAA
```

FIGURE 187

MAQLERSAISGFSSKSRRNSFAYDVKREVYNEETFQQEHKRKASSSGNMNINITTFRHHVQCRCSWHRFLRCVLT
IFPFLEWMCMYRLKDWLLGDLLAGISVGLVQVPQGLTLSLLARQLIPPLNIAYAAFCSSVIYVIFGSCHQMSIGS
FFLVSALLINVLKVSPFNNGQLVMGSFVKNEFSAPSYLMGYNKSLSVVATTTFLTGIIQLIMGVLGLGFIATYLP
ESAMSAYLAAVALHIMLSQLTFIFGIMISFHAGPISFFYDIINYCVALPKANSTSILVFLTVVVALRINKCIRIS
FNQYPIEFPMELFLIIGFTVIANKISMATETSQTLIDMIPYSFLLPVTPDFSLLPKIILQAFSLSLVSSFLLIFL
GKKIASLHNYSVNSNQDLIAIGLCNVVSSFFRSCVFTGAIARTIIQDKSGGRQQFASLVGAGVMLLLMVKMGHFF
YTLPNAVLAGIILSNVIPYLETISNLPSLWRQDQYDCALWMMTFSSSIFLGLDIGLIISVVSAFFITTVRSHRAK
ILLLGQIPNTNIYRSINDYREIITIPGVKIFQCCSSITFVNVYYLKHKLLKEVDMVKVPLKEEEIFSLFNSSDTN
LQGGKICRCFCNCDDLEPLPRILYTERFENKLDPEASSINLIHCSHFESMNTSQTASEDQVPYTVSSVSQKNQGQ
QYEEVEEVWLPNNSSRNSSPGLPDVAESQGRRSLIPYSDASLLPSVHTIILDFSMVHYVDSRGLVVLRQICNAFQ
NANILILIAGCHSSIVRAFERNDFFDAGITKTQLFLSVHDAVLFALSRKVIGSSELSIDESETVIRETYSETDKN
DNSRYKMSSSFLGSQKNVSPGFIKIQQPVEEESELDLELESEQEAGLGLDLDLDRELEPEMEPKAETETKTQTEM
EPQPETEPEMEPNPKSRPRAHTFPQQRYWPMYHPSMASTQSQTQTRTWSVERRRHPMDSYSPEGNSNEDV

FIGURE 188A

```
GAATTCGGGATCAGGGCAAGCATTGTGGAGCGGTTCCTTATGCCAGGCTGCCATGTGAGATGATCCAAGACCAAA
ACAAGGCCCTAGACTGCAGTAAAACCCAGAACTCAAGTAGGGCAGAAGGTGGAAGGCTCATATGGATAGAAGGCC
CAAAGTATAAGACAGATGGTTTGAGACTTGAGACCCGAGGACTAAGATGGAAAGCCCATGTTCCAAGA<u>TAG</u>ATAG
AAGCCTCAGGCCTGAAACCAACAAAAGCCTCAAGAGCCAAGAAAACAGAGGGTGGCCTGAATTGGACCGAAGGCC
TGAGTTGGATGGAAGTCTCAAGGCTTGAGTTAGAAGTCTTAAGACCTGGGACAGGACACATGGAAGGCCTAAGAA
CTGAGACTTGTGACACAAGGCCAACGACCTAAGATTAGCCCAGGGTTGTAGCTGGAAGACCTACAACCCAAGGAT
GGAAGGCCCCTGTCACAAAGCCTACCTAGATGGATAGAGGACCCAAGCGAAAAAGGTATCTCAAGACTAACGGCC
GGAATCTGGAGGCCCATGACCCAGAACCCAGGAAGGATAGAAGCTTGAAGACCTGGGGAAATCCCAAGATGAGAA
CCCTAAACCCTACCTCTTTTCTATTGTTTACACTTCTTACTCTTAGATATTTCCAGTTCTCCTGTTTATCTTTAA
GCCTGATTCTTTTGAGATGTACTTTTTGATGTTGCCGGTTACCTTTAGATTGACAGTATTATGCCTGGGCCAGTC
TTGAGCCAGCTTTAAATCACAGCTTTTACCTATTTGTTAGGCTATAGTGTTTTGTAAACTTCTGTTTCTATTCAC
ATCTTCTCCACTTGAGAGAGACACCAAAATCCAGTCAGTATCTAATCTGGCTTTTGTTAACTTCCCTCAGGAGCA
GACATTCATATAGGTGATACTGTATTTCAGTCCTTTCTTTTGACCCCAGAAGCCCTAGACTGAGAAGATAAAATG
GTCAGGTTGTTGGGGAAAAAAAGTGCCAGGCTCTCTAGAGAAAAATGTGAAGAGATGCTCCAGGCCAATGAGAA
GAATTAGACAAGAAATACACAGATGTGCCAGACTTCTGAGAAGCACCTGCCAGCAACAGCTTCCTTCTTTGAGCT
TAGGTGAGCAGGATTCTGGGGTTTGGGATTTCTAGTGATGGTTATGGAAAGGGTGACTGTGCCTGGGACAAAGCG
AGGTCCCAAGGGGACAGCCTGAACTCCCTGCTCATAGTAGTGGCCAAATAATTTGGTGGACTGTGCCAACGCTAC
TCCTGGGTTAATACCCATCTCTAGGCTTAAAGATGAGAGAACCTGGGACTGTTGAGCATGTTTAATACTTTCCT
TGATTTTTTCTTCCTGTTTATGTGGGAAGTTGATTTAAATGACTGATAATGTGTATGAAAGCACTGTAAAACAT
AAGAGAAAAACCAATTAGTGTATTGGCAATCATGCAGTTAACATTTGAAAGTGCAGTGTAAATTGTGAAGCATTA
TGTAAATCAGGGGTCCACAGTTTTTCTGTAAGGGGTCAAATCATAAATACTTTAGACTGTGGGCCATATGGTTTC
TGTTACATATTTGTTTTTTAAACAACGTTTTTATAAGGTCAAAATCATTCTTAGTTTTTGAGCCAATTGGATTTG
GCCTGCTGTTCATAGCTTACCACCCCCTGATGTATTATTTGTTATTCAGAGAAAATTTCTGAATACTACTAGTTT
CCTTTTCTGTGCCTGTCCCTGTGCTAGGCACTAAAAATGCAATGATTATTGATATCTAGGTGACCTGAAAAAAAA
TAGTGAATGTGCTTTGTAAACTGTAAAGCACTTGTATTCTACTGTGATAAGCGTTGTGGATACAAAGAAAGGAGC
AAGCATAAAAAAGTGCTCTTTCAAAAGGATATAGTACTATGCAGACACAAGGAATTGTTTGATAAATGAATAAAT
TATATGTATATTTGAGGCCAATTTGTGTTTGCTGCTCTGGTAATTTTGAGTAAAAATGCAGTATTCCAGGTATCA
GAAACGAAAACACATGGAAACTGCTTTTAAACTTTAAAATATACTGAAAACATAAGGGACTAAGCTTGTTGTGGT
CACCTATAATGTGCCAGATACCATGCTGGGTGCTAGAGCTACCAAAGGGGGAAAAGTATTCTCATAGAACAAAAA
ATTTCAGAAAGGTGCATATTAAAGTGCTTTGTAAACTAAAGCATGATACAAATGTCAATGGGCTACATATTTATG
AATGAATGAATGGATGAATGAATATTAAGTGCCTCTTACATACCAGCTATTTGGGTACTGTAAAATACAAGATT
AATTCTCCTATGTAATAAGAGGAAAGTTTATCCTCTATACTATTCAGATGTAAGGAATGATATATTGCTTAATTT
TAAACAATCAAGACTTTACTGGTGAGGTTAAGTTAAATTATTACTGATACATTTTCCAGGTAACCAGGAAAGAG
CTAGTATGAGGAAATGAAGTAATAGATGTGAGATCCAGACCGAAAGTCACTTAATTCAGCTTGCGAATGTGCTTT
CTAAATTATAAAGCACTTGTAAATGAAAAATTTGATGCTTTCTGTATGAATAAAACTTTCTGTAAGCTAGGTATT
GTCTCTACAAAATTCTCATTGTATAGTTAAACCACAGTGAGAAGGGTTCTATAAGTAGTTATACAAACCAAGGGT
TTAAATACCTGTTAAATAGATCAATTTTGATTGCCTACTATGTGAACTCACTGTTAAAGGCACTGAAAATTTATC
ATATTTCATTTAGCCACAGCCAAAAATAAGGCAATACCTATGTTAGCATTTTGTGAACTCTAAGGCACCATATAA
ATGTAACTGTTGATTTCTCACTTGGTGCTGGGTACTAGGTTTATAAAATTGTATGATAGTTATTATATTGTGCA
AATAAAGTAGGAAAATTTGAATAACAATGATTATCTTTTGAATACGCATACGCAAGGGATTGGTTGTCTGAAGAA
TGCCACTATAGTAGTTATCTATTGTGTGCCAATCTCATTGCTAGGCATTGGGGATGCAAAGATAAACCATCTTTA
TTGTGTCTTGGGTAGCAGAAGAAAATATGTGTAAAATCAATTTATAATTTGTAAACTGCCACCCATATATAAGCT
ATATCTGCTGAATGATCATTGATTACTCTTATCCTTAGAGATAACAACTGGGGCACAAACATTTATTATCATTA
TTGAACCTACAACAGAGATCTATGTGTAGATTTACAAAGCCTACAGTTCTATACAGATAGGAATGAACTATTGGC
TTACTGAATGGTGATTACTTTCTGTGGGCTCGGAACTACATGCCCTAGGATATAAAAATGATGTTATCATTATA
GAGTGCTCACAGAAGGAAATGAAGTAATATAGGTGTGAGATCCAGACCAAAAGTCATTTAACAAGTTTATTCAGT
GATGAAAACATGGGACAAATGGACTAATATAAGGCAGTGTACTAAGCTGAGTAGAGAGATAAAGTCCTGTCCAGA
AGATACATGCTTCCTGGCCTGATTGAGGAGATGGAAAATTTTTGCAAAACAAGGTGTTGTGGTCTTCCATCCAGT
```

FIGURE 188B

```
TTCTTAAGTGCTGATGATAAAAGTGAATTAGACCCACCTTGACCTGGCCTACAGAAGTAAAGGAGTAAAAATAAA
TGCCTCAGGCGTGCTTTTTGATTCATTTGATAAACAAAGCATCTTTTATGTGGAATATACCATTCTGGGTCCTGA
GGATAAGAGAGATGAGGGCATTAGATCACTGACAGCTGAAGATAGAAGAACATCTTTGGTTTGATTGTTTAAATA
ATATTTCAATGCCTATTCTCTGCAAGGTACTATGTTTCGTAAATTAAATAGGTCTGGCCCAGAAGACTCCCTGGC
ATTGATCGGCATAGATGGCAGCGCTGGAGGAGGACTTGTACTGGGGCCGCTGGCCCCACATCAGTGTCCGTCATC
CCGGCGTCCAGCCCCTGGTGTGCTGAAGCTCAGGCCCTTCCTTGTGCCCTAGTCTCCTGCACTGAGCTTGTGAGC
TCTTCTGCTCAGGCGGGTCCCCTGGCATTGACCAGCATAGATGGTGGCCCTGGAGGAGGACTTGTATTGGGGCAC
TGGCCCACGTCAGTGTTCGTCAGCTGGCATCAGCCCTGGTGTGTGAAGTCAGGCCTTCTGTTGCCTA
```

FIGURE 189

IRDQGKHCGAVPYARLPCEMIQDQNKALDCSKTQNSSRAEGGRLIWIEGPKYKTDGLRLETRGLRWKAHVPR

FIGURE 190

```
GTCACCCCCAGCGGGCGCGGGCCGGAGCACGGGCACCCAGCATGGGGGTACTGCTCACACAGAGGACGCTGCTCA
GTCTGGTCCTTGCACTCCTGTTTCCAAGCATGGCGAGCATGGCGGCTATAGGCAGCTGCTCGAAAGAGTACCGCG
TGCTCCTTGGCCAGCTCCAGAAGCAGACAGATCTCATGCAGGACACCAGCAGACTCCTGGACCCCTATATACGTA
TCCAAGGCCTGGATGTTCCTAAACTGAGAGAGCACTGCAGGGAGCGCCCCGGGGCCTTCCCCAGTGAGGAGACCC
TGAGGGGGCTGGGCAGGCGGGGCTTCCTGCAGACCCTCAATGCCACACTGGGCTGCGTCCTGCACAGACTGGCCG
ACTTAGAGCAGCGCCTCCCCAAGGCCCAGGATTTGGAGAGGTCTGGGCTGAACATCGAGGACTTGGAGAAGCTGC
AGATGGCGAGGCCGAACATCCTCGGGCTCAGGAACAACATCTACTGCATGGCCCAGCTGCTGGACAACTCAGACA
CGGCTGAGCCCACGAAGGCTGGCCGGGGGGCCTCTCAGCCGCCCACCCCCACCCCTGCCTCGGATGCTTTTCAGC
GCAAGCTGGAGGGCTGCAGGTTCCTGCATGGCTACCATCGCTTCATGCACTCAGTGGGGCGGGTCTTCAGCAAGT
GGGGGGAGAGCCCGAACCGGAGCCGGAGACACAGCCCCCACCAGGCCCTGAGGAAGGGGGTGCGCAGGACCAGAC
CCTCCAGGAAAGGCAAGAGACTCATGACCAGGGGACAGCTGCCCCGGTAGCCTCGAGAGCACCCCTTGCCGGTGA
AGGATGCGGCAGGTGCTCTGTGGATGAGAGGAACCATCGCAGGATGACAGCTCCCGGGTCCCCAAACCTGTTCCC
CTCTGCTACTAGCCACTGAGAAGTGCACTTTAAGAGGTGGGAGCTGGGCAGACCCCTCTACCTCCTCCAGGCTGG
GAGACAGAGTCAGGCTGTTGCGCTCCCACCTCAGCCCCAAGTTCCCCAGGCCCAGTGGGGTGGCCGGGCGGGCCA
CGCGGGACCGACTTTCCATTGATTCAGGGGTCTGATGACACAGGCTGACTCATGGCCGGGCTGACTGCCCCCCTG
CCTTGCTCCCCGAGGCCTGCCGGTCCTTCCCTCTCATGACTTGCAGGGCCGTTGCCCCCAGACTTCCTCCTTTCC
GTGTTTCTGAAGGGGAGGTCACAGCCTGAGCTGGCCTCCTATGCCTCATCATGTCCCAAACCAGACACCTGGATG
TCTGGGTGACCTCACTTTAGGCAGCTGTAACAGCGGCAGGGTGTCCCAGGAGCCCTGATCCGGGGGTCCAGGGAA
TGGAGCTCAGGTCCCAGGCCAGCCCCGAAGTCGCCACGTGGCCTGGGGCAGGTCACTTTACCTCTGTGGACCTGT
TTTCTCTTTGTGAAGCTAGGGAGTTAGAGGCTGTACAAGGCCCCACTGCCTGTCGGTTGCTTGGATTCCCTGAC
GTAAGGTGGATATTAAAAATCTGTAAATCAGGACAGGTGGTGCAAATGGCGCTGGGAGGTGTACACGGAGGTCTC
TGTAAAAGCAGACCCACCTCCCAGCGCCGGGAAGCCCGTCTTGGGTCCTCGCTGCTGGCTGCTCCCCCTGGTGGT
GGATCCTGGAATTTTCTCACGCAGGAGCCATTGCTCTCCTAGAGGGGGTCTCAGAAACTGCGAGGCCAGTTCCTT
GGAGGGACATGACTAATTTATCGATTTTTATCAATTTTTATCAGTTTTATATTTATAAGCCTTATTTATGATGTA
TATTTAATGTTAATATTGTGCAAACTTATATTTAAAACTTGCCTGGTTTCTAAAAAAAAAAAAAAAAAAA
```

FIGURE 191

MGVLLTQRTLLSLVLALLFPSMASMAAIGSCSKEYRVLLGQLQKQTDLMQDTSRLLDPYIRIQGLDVPKLREHCR
ERPGAFPSEETLRGLGRRGFLQTLNATLGCVLHRLADLEQRLPKAQDLERSGLNIEDLEKLQMARPNILGLRNNI
YCMAQLLDNSDTAEPTKAGRGASQPPTPTPASDAFQRKLEGCRFLHGYHRFMHSVGRVFSKWGESPNRSRRHSPH
QALRKGVRRTRPSRKGKRLMTRGQLPR

FIGURE 192

CAGGCCTTGAGGTTTTGGCAGCTCTGGAGGATGAGAGAGAACATGGCCAGGGGCCCTTGCAACGCGCCGAGATGG
GTGTCCCTGATGGTGCTCGTCGCCATAGGCACCGCCGTGACAGCGGCCGTCAACCCTGGCGTCGTGGTCAGGATC
TCCCAGAAGGGCCTGGACTACGCCAGCCAGCAGGGGACGGCCGCTCTGCAGAAGGAGCTGAAGAGGATCAAGATT
CCTGACTACTCAGACAGCTTTAAGATCAAGCATCTTGGGAAGGGGCATTATAGCTTCTACAGCATGGACATCCGT
GAATTCCAGCTTCCCAGTTCCCAGATAAGCATGGTGCCCAATGTGGGCCTTAAGTTCTCCATCAGCAACGCCAAT
ATCAAGATCAGCGGGAAATGGAAGGCACAAAAGAGATTCTTAAAAATGAGCGGCAATTTTGACCTGAGCATAGAA
GGCATGTCCATTTCGGCTGATCTGAAGCTGGGCAGTAACCCCACGTCAGGCAAGCCCACCATCACCTGCTCCAGC
TGCAGCAGCCACATCAACAGTGTCCACGTGCACATCTCAAAGAGCAAAGTCGGGTGGCTGATCCAACTCTTCCAC
AAAAAAATTGAGTCTGCGCTTCGAAACAAGATGAACAGCCAGGTCTGCGAGAAAGTGACCAATTCTGTATCCTCC
AAGCTGCAACCTTATTTCCAGACTCTGCCAGTAATGACCAAAATAGATTCTGTGGCTGGAATCAACTATGGTCTG
GTGGCACCTCCAGCAACCACGGCTGAGACCCTGGATGTACAGATGAAGGGGGAGTTTTACAGTGAGAACCACCAC
AATCCACCTCCCTTTGCTCCACCAGTGATGGAGTTTCCCGCTGCCCATGACCGCATGGTATACCTGGGCCTCTCA
GACTACTTCTTCAACACAGCCGGGCTTGTATACCAAGAGGCTGGGGTCTTGAAGATGACCCTTAGAGATGACATG
ATTCCAAAGGAGTCCAAATTTCGACTGACAACCAAGTTCTTTGGAACCTTCCTACCTGAGGTGGCCAAGAAGTTT
CCCAACATGAAGATACAGATCCATGTCTCAGCCTCCACCCCGCCACACCTGTCTGTGCAGCCCACCGGCCTTACC
TTCTACCCTGCCGTGGATGTCCAGGCCTTTGCCGTCCTCCCCAACTCCTCCCTGGCTTCCCTCTTCCTGATTGGC
ATGCACACAACTGGTTCCATGGAGGTCAGCGCCGAGTCCAACAGGCTTGTTGGAGAGCTCAAGCTGGATAGGCTG
CTCCTGGAACTGAAGCACTCAAATATTGGCCCCTTCCCGGTTGAATTGCTGCAGGATATCATGAACTACATTGTA
CCCATTCTTGTGCTGCCCAGGGTTAACGAGAAACTACAGAAAGGCTTCCCTCTCCCGACGCCGGCCAGAGTCCAG
CTCTACAACGTAGTGCTTCAGCCTCACCAGAACTTCCTGCTGTTCGGTGCAGACGTTGTCTATAAATGAAGGCAC
CAGGGGTGCCGGGGGCTGTCAGCCGCACCTGTTCCTGATGGGCTGTGGGGCACCGGCTGCCTTTCCCCAGGGAAT
CCTCTCCAGATCTTAACCAAGAGCCCCTTGCAAACTTCTTCGACTCAGATTCAGAAATGATCTAAACACGAGGAA
ACATTATTCATTGGAAAAGTGCATGGTGTGTATTTTAGGGATTATGAGCTTCTTTCAAGGGCTAAGGCTGCAGAG
ATATTTCCTCCAGGAATCGTGTTTCAATTGTAACCAAGAAATTTCCATTTGTGCTTCATGAAAAAAAACTTCTGG
TTTTTTTCATGTG

FIGURE 193

MRENMARGPCNAPRWVSLMVLVAIGTAVTAAVNPGVVVRISQKGLDYASQQGTAALQKELKRIKIPDYSDSFKIK
HLGKGHYSFYSMDIREFQLPSSQISMVPNVGLKFSISNANIKISGKWKAQKRFLKMSGNFDLSIEGMSISADLKL
GSNPTSGKPTITCSSCSSHINSVHVHISKSKVGWLIQLFHKKIESALRNKMNSQVCEKVTNSVSSKLQPYFQTLP
VMTKIDSVAGINYGLVAPPATTAETLDVQMKGEFYSENHHNPPPFAPPVMEFPAAHDRMVYLGLSDYFFNTAGLV
YQEAGVLKMTLRDDMIPKESKFRLTTKFFGTFLPEVAKKFPNMKIQIHVSASTPPHLSVQPTGLTFYPAVDVQAF
AVLPNSSLASLFLIGMHTTGSMEVSAESNRLVGELKLDRLLLELKHSNIGPFPVELLQDIMNYIVPILVLPRVNE
KLQKGFPLPTPARVQLYNVVLQPHQNFLLFGADVVYK

FIGURE 194

```
GCTCACTGAGCACCGTCCCAGCATCCGGACACCACAGCGGCCCTTCGCTCCACGCAGAAAACCACACTTCTCATA
CCTTCACTCAACACTTCCTTCCCCAAAGCCAGAAGATGCACAAGGAGGAACATGAGGTGGCTGTGCTGGGGGCAC
CCCCCAGCACCATCCTTCCAAGGTCCACCGTGATTAACATCCACAGCGAGACCTCCGTGCCCGACCATGTCGTCT
GGTCCCTGTTCAACACCCTCTTCTTGAACTGGTGCTGTCTGGGCTTCATAGCATTCGCCTACTCCGTAAAGTCTA
GGGACAGGAAGATGGTTGGCGACGTGACCGGGGCCCAGGCCTATGCCTCCACCGCCAAGTGCCTGAACATCTGGG
CCCTGATTCTGGGCATCCTCATGACCATTGGATTCATCCTGTTACTGGTATTCGGCTCTGTAACAGTCTACCATA
TTATGTTACAGATAATACAGGAAAAACGGGGTTACTAGTAGCCGCCCATAGCCTGCAACCTTTGCACTCCACTGT
GCAATGCTGGCCCTGCACGCTGGGGCTGTTGCCCCTGCCCCTTGGTCCTGCCCCTAGATACAGCAGTTTATACC
CACACACCTGTCTACAGTGTCATTCAATAAAGTGCACGTGCTTGTGA
```

FIGURE 195

MHKEEHEVAVLGAPPSTILPRSTVINIHSETSVPDHVVWSLFNTLFLNWCCLGFIAFAYSVKSRDRKMVGDVTGA
QAYASTAKCLNIWALILGILMTIGFILLLVFGSVTVYHIMLQIIQEKRGY

FIGURE 196

```
ATGTGGTTCTTGACAACTCTGCTCCTTTGGGTTCCAGTTGATGGGCAAGTGGACACCACAAAGGCAGTGATCACT
TTGCAGCCTCCATGGGTCAGCGTGTTCCAAGAGGAAACCGTAACCTTGCACTGTGAGGTGCTCCATCTGCCTGGG
AGCAGCTCTACACAGTGGTTTCTCAATGGCACAGCCACTCAGACCTCGACCCCCAGCTACAGAATCACCTCTGCC
AGTGTCAATGACAGTGGTGAATACAGGTGCCAGAGAGGTCTCTCAGGGCGAAGTGACCCCATACAGCTGGAAATC
CACAGAGGCTGGCTACTACTGCAGGTCTCCAGCAGAGTCTTCACGGAAGGAGAACCTCTGGCCTTGAGGTGTCAT
GCGTGGAAGGATAAGCTGGTGTACAATGTGCTTTACTATCGAAATGGCAAAGCCTTTAAGTTTTTCCACTGGAAT
TCTAACCTCACCATTCTGAAAACCAACATAAGTCACAATGGCACCTACCATTGCTCAGGCATGGGAAAGCATCGC
TACACATCAGCAGGAATATCTGTCACTGTGAAAGAGCTATTTCCAGCTCCAGTGCTGAATGCATCTGTGACATCC
CCACTCCTGGAGGGGAATCTGGTCACCCTGAGCTGTGAAACAAAGTTGCTCTTGCAGAGGCCTGGTTTGCAGCTT
TACTTCTCCTTCTACATGGGCAGCAAGACCCTGCGAGGCAGGAACACATCCTCTGAATACCAAATACTAACTGCT
AGAAGAGAAGACTCTGGGTTATACTGGTGCGAGGCTGCCACAGAGGATGGAAATGTCCTTAAGCGCAGCCCTGAG
TTGGAGCTTCAAGTGCTTGGCCTCCAGTTACCAACTCCTGTCTGGTTTCATGTCCTTTTCTATCTGGCAGTGGGA
ATAATGTTTTTAGTGAACACTGTTCTCTGGGTGACAATACGTAAAGAACTGAAAAGAAAGAAAAAGTGGGATTTA
GAAATCTCTTTGGATTCTGGTCATGAGAAGAAGGTAATTTCCAGCCTTCAAGAAGACAGACATTTAGAAGAAGAG
CTGAAATGTCAGGAACAAAAAGAAGAACAGCTGCAGGAAGGGGTGCACCGGAAGGAGCCCCAGGGGGCCACGTAG
CAG
```

FIGURE 197

```
MWFLTTLLLWVPVDGQVDTTKAVITLQPPWVSVFQEETVTLHCEVLHLPGSSSTQWFLNGTATQTSTPSYRITSA
SVNDSGEYRCQRGLSGRSDPIQLEIHRGWLLLQVSSRVFTEGEPLALRCHAWKDKLVYNVLYYRNGKAFKFFHWN
SNLTILKTNISHNGTYHCSGMGKHRYTSAGISVTVKELFPAPVLNASVTSPLLEGNLVTLSCETKLLLQRPGLQL
YFSFYMGSKTLRGRNTSSEYQILTARREDSGLYWCEAATEDGNVLKRSPELELQVLGLQLPTPVWFHVLFYLAVG
IMFLVNTVLWVTIRKELKRKKKWDLEISLDSGHEKKVISSLQEDRHLEEELKCQEQKEEQLQEGVHRKEPQGAT
```

FIGURE 198

```
GAAGAAGAAGACCACAAAAGACATGACTATCCAACTTTTTATGACAAACTGCAAGGAATAAAGGAAGAATAAGTC
CATGTACTGTACCACAGAAGTTCTGTCTGCATCTTGGACCTGAACTTGATCATCATCAGCTTGATAAGAGACTTT
TTGACTCTATATCCTTGCAGTTAAGAAGAAAGCACTTTTTTGTAATGTTTGTTTTAATGGTTCAAAAAAAATCTT
TCTTATAAAGAGCATAGGTAGAATTAGTGAACTCTTTGGATCCTTTGTACAGATAAAGGTTATAGATTTCTTGTG
TTGAATATTAAAAAAGCAAGGATGTCTAACCATTAAGATTATCCAAAGTCAGGCGTGAGCCACTGTGCCTGGCCC
CAAGTTTTGCATCTTTTAATGCCCTCTGAACAAATACATAGAGAAAACTCTCAGAACAATTAAAACCTGCAGAGC
AACAGTGTCCTCCATGTCTTAGGTTTCAAGTTTGCCTCTAAAATTCTAATCCATATTTTTCTACTTCTCAGATAA
TTTATGTGTGTGTACTCTTCCTAGACGTACAAGAGACTTTTTAATGCTAAATATTTGTCAGTGCTTAACAAAAAC
TCAATTTCACATTACTCATATTGTTTTTGTTTAATTGAATGTGAATTAAATTTTTATTAGTTATTTGATTTGGA
ATGTTATGTATGCCATTAACACTATTAGGGGAATCTCTAGCATTTCTGTATTTTAAAGAATTTGATTCTTTTGT
AGATTCTGCCTGTGTGGTCATTTTAAAACATGTGTGACATATATCAGTACCTTCATTCTTCTATATTTGTGTCT
CCTCCAACCTCCAACTTTTTTTGTTTTTTGAAAAATGTTTCTCTAACACCTCAACAGTTTAAGGTAATTTAGTAC
ACATATATCAGTATTTTTGTGATCTGAAAAAGCAACCCATTTTCTAAATTCATATTTTTCCTAAAACTTTACTAT
GTTTTTATTTTAAGAGGTTTCCTGTTATATACACTTTTTACACATGCAAATAAACTTTATACCAAGTGAGT
```

FIGURE 199

MQINFIPS

FIGURE 200

```
GCTCATCCGAGGGCTTCCTGATGTGACGGACTGTGAAGAGGCAGCCCTGGATGACCTCTGTGCCGCGGAAACCGA
TGTGGAAGACCCCGAGGTGGAGTGTGGCTGAGGCCCTGAGTGTCCAGCCACATGGTGGCACCAGCACCACTCCTT
TCCTTACCACATCAACTGATTAAAGCAGTGACCAGCAGGAACTGCCCAGAGAACTGGCTGGCCTTGTTTCCTGAG
TCTGATCTGTTTGGCGGAGTGGGAGGGGTGGAGCAGGACCCGGACCCTGAGTGGCTGGGATCCTTCTTCCTGTCC
CTGGCTGTTGCTGAGCCCGTCCCCATGGTAACTGATCTGCCTTGAGGAAGGAGCCCTGCCCTGCCTGTGGAATTG
TCCTGAGTCATTGCTTTGGGCTGGGGCCATGGGAAGAAACCATTGTGTGGCAGGGAAGGAGGTGGCTCTTGGCCC
AGGCCTAAACCAGGAAAGCCTGGGAAACTGGGACCCACAGGTGGGCATGAAAGGGCCGCAGCAGGGGCTCCCAGC
AGTGTGTAAGACCGGGAGCTGGTCTGGCACCACTGCCCTGGTCCTTCCAGCTGCCTGTCACTGGTATGATGGCCC
CGGTGCATTGTGCCACCAGCAGGCCACAGCTGTGGATCTTGGAAGGCCTCTGGGGTCCCCGGGAGCAGGGGAGT
GGGTGTGGGGGGGAACGGATGGTGGTGAGAGGGACAGACCAGGCAGGCTGACGAGCAGGGCGGGCCTGGCTCACG
TGGGCCTGTAGGCGGGCCCACGCCAAGTTTCACTTACCGCCACTGCTGCCAGCGAGAGCCGCGGGAGAGTGTGCA
GCCGAGTCACTACTGCCTGCCTGCCTGCCTGCTACGGCTCAGCAGCAGGTACGTACCCAACCATGGGCTCGCAGG
CCCTGCCCCCGGGGCCCATGCAGACCCTCATCTTTTCGACATGGAGGCCACTGGCTTGCCCTTCTCCCAGCCCA
AGGTCACGGAGCTGTGCCTGCTGGCTGTCCACAGATGTGCCCTGGAGAGCCCCCCCACCTCTCAGGGCCACCTC
CCACAGTTCCTCCACCACCGCGTGTGGTAGACAAGCTCTCCCTGTGTGTGGCTCCGGGGAAGGCCTGCAGCCCTG
CAGCCAGCGAGATCACAGGTCTGAGCACAGCTGTGCTGGCAGCGCATGGGCGTCAATGTTTGATGACAACCTGG
CCAACCTGCTCCTAGCCTTCCTGCGGCGCCAGCCACAGCCCTGGTGCCTGGTGGCACACAATGGTGACCGCTACG
ACTTCCCCCTGCTCCAAGCAGAGCTGGCTATGCTGGGCCTCACCAGTGCTCTGGATGGTGCCTTCTGTGTGGATA
GCATCACTGCGCTGAAGGCCCTGGAGCGAGCAAGCAGCCCCTCAGAACACGGCCCAAGGAAGAGCTACAGCCTAG
GCAGCATCTACACTCGCCTGTATGGGCAGTCCCTCCAGACTCGCACACGGCTGAGGGTGATGTCCTGGCCCTGC
TCAGCATCTGTCAGTGGAGACCACAGGCCCTGCTGCGGTGGGTGGATGCTCACGCCAGGCCTTCGGCACCATCA
GGCCCATGTATGGGGTCACAGCCTCTGCTAGGACCAAGCCAAGACCATCTGCTGTCACAACCACTGCACACCTGG
CCACAACCAGGAACACTAGTCCCAGCCTTGGAGAGAGCAGGGGTACCAAGGATCTTCCTCCAGTGAAGGACCCTG
GAGCCCTATCCAGGGAGGGGCTGCTGGCCCCACTGGGTCTGCTGGCCATCCTGACCTTGGCAGTAGCCACACTGT
ATGGACTATCCCTGGCCACACCTGGGGAGTAGGCCAAGAAGGAAAATCTGACGAATAAAGACCCCCGCTGCCCCA
TAAAAAAAAAAAAAAAAAAAAAAAAAAAAAAAAAAAAAAAA
```

FIGURE 201

MGSQALPPGPMQTLIFFDMEATGLPFSQPKVTELCLLAVHRCALESPPTSQGPPPTVPPPPRVVDKLSLCVAPGK
ACSPAASEITGLSTAVLAAHGRQCFDDNLANLLLAFLRRQPQPWCLVAHNGDRYDFPLLQAELAMLGLTSALDGA
FCVDSITALKALERASSPSEHGPRKSYSLGSIYTRLYGQSPPDSHTAEGDVLALLSICQWRPQALLRWVDAHARP
FGTIRPMYGVTASARTKPRPSAVTTTAHLATTRNTSPSLGESRGTKDLPPVKDPGALSREGLLAPLGLLAILTLA
VATLYGLSLATPGE

FIGURE 202

ATGTCAGCCCCACTGGATGCCGCCCTCCACGCCCTTCAGGAGGAGCAGGCCAGACCGCCCTCCACGCCCTTCAGG
AGGAGCAGGCCAGACTCAAGATGAGGCTGTGGGACCTGCAGCAGCTGAGAAAGGAGCTCGGGGACTCCCCCAAAG
ACAAGGTCCCATTTTCAGTGCCCAAGATCCCCCTGGTATTCCGAGGACACACCCAGCAGGACCCGGAAGTGCCTA
AGTCTTTAGTTTCCAATTTGCGGATCCACTGCCCTCTGCTTGCGGGCTCTGCTCTGATCACCTTTGATGACCCCA
AAGTGGCTGAGCAGGTGCTGCAACAAAAGGAGCACACGATCAACATGGAGGAGTGCCGGCTGCGGGTGCAGGTCC
AGCCCTTGGAGCTGCCCATGGTCACCACCATCCAGGTGATGGTGTCCAGCCAGTTGAGTGGCCGGAGGGTGTTGG
TCACTGGATTTCCTGCCAGCCTCAGGCTGAGTGAGGAGGAGCTGCTGGACAAGCTAGAGATCTTCTTTGGCAAGA
CTAGGAACGGAGGTGGCGATGTGGACGTTCGGGAGCTACTGCCAGGGAGTGTCATGCTGGGGTTTGCTAGGGATG
GAGTGGCTCAGCGTCTGTGCCAAATCGGCCAGTTCACAGTGCCACTGGGTGGGCAGCAAGTCCCTCTGAGAGTCT
CTCCGTATGTGAATGGGGAGATCCAGAAGGCTGAGATCAGGTCGCAGCCAGTTCCCCGCTCGGTACTGGTGCTCA
ACATTCCTGATATCTTGGATGGCCCGGAGCTGCATGACGTCCTGGAGATCCACTTCCAGAAGCCCACCCGCGGGG
GCGGGGAGGTAGAGGCCCTGACAGTCGTACCCCAAGGACAGCAGGGCCTAGCAGTCTTCACCTCTGAGTCAGGCT
AGGGGCCTCCCCTTCTCATCCTCCCCACCCCCCGCCAAGGTTCTCACACTGGCCTGGGCTTGGGTGCCCATATA
GGAGGTCTGTATGTTCACCAACAGTGCGGAGGGGTCACACATTGCAAAACACTGCCCAGAACAGTAAAAAGAGCC
TGCATGCCAAAAAAAAAAAAAAAAAAAAAAAAAAAAAAAAAAAAAAAAAAAA

FIGURE 203A

```
AAAAATAACAGCCGTATGCCTCTGCTAAGTACTAACTACCTCATCACCTTTTGTGCAGACAGGCAGGTTACATTT
GGTTTAAGGAATTAGGAATATGTTCTTTCCAGCACCTTAGTAACCCACGCGATTGTGATTCTTTTCTCTTCTTGA
CTGTGATAGGTGGCATGGAATATTCACATGGGAGAGCCGCATGAGGCCGCCCACCACGCTTCCTGAAGGATGCCC
GTGTGGAAGAATTTTGACGTGCCAGTGTCCTCGTTCTACAGGGTGTTCCATTCTTCCGCAATCTCAGAAAAATGG
GACTAAAAGAAACTATTTTGTAAAATAAGAAGACTTCCATTTTTAATGACCAACATGTATTAAGATGGACACCTA
CTCTACGAAACACGAAGTTCTATGGTCTCGAAGAAGCCCGTGCCTGTTTAAAACTGATCCTAACTAAAAACAGAC
TTGAGTGGATATGAGAATGTTGGTTAGTGGCAGAAGAGTCAAAAAATGGCAGTTAATTATTCAGTTATTTGCTAC
TTGTTTTTTAGCGAGCCTCATGTTTTTGGGAACCAATCGATAATCACATTGTGAGCCATATGAAGTCATATTC
TTACAGATACCTCATAAATAGCTATGACTTTGTGAATGATACCCTGTCTCTTAAGCACACCTCAGCGGGGCCTCG
CTACCAATACTTGATTAACCACAAGGAAAAGTGTCAAGCTCAAGACGTCCTCCTTTTACTGTTTGTAAAAACTGC
TCCTGAAAACTATGATCGACGTTCCGGAATTAGAAGGACGTGGGGCAATGAAAATTATGTTCGGTCTCAGCTGAA
TGCCAACATCAAAACTCTGTTTGCCTTAGGAACTCCTAATCCACTGGAGGGAGAAGAACTACAAAGAAAACTGGC
TTGGGAAGATCAAAGGTACAATGATATAATTCAGCAAGACTTTGTTGATTCTTTCTACAATCTTACTCTGAAATT
ACTTATGCAGTTCAGTTGGGCAAATACCTATTGTCCACATGCCAAATTTCTTATGACTGCTGATGATGACATATT
TATTCACATGCCAAATCTGATTGAGTACCTTCAAAGTTTAGAACAAATTGGTGTTCAAGACTTTTGGATTGGTCG
TGTTCATCGTGGTGCCCCTCCCATTAGAGATAAAAGCAGCAAATACTACGTGTCCTATGAAATGTACCAGTGGCC
AGCTTACCCTGACTACACAGCCGGAGCTGCCTATGTAATCTCCGGTGATGTAGCTGCCAAAGTCTATGAGGCATC
ACAGACACTAAATTCAAGTCTTTACATAGACGATGTGTTCATGGGCCTCTGTGCCAATAAAATAGGGATAGTACC
GCAGGACCATGTGTTTTTTCTGGAGAGGGTAAAACTCCTTATCATCCCTGCATCTATGAAAAAATGATGACATC
TCATGGACACTTAGAAGATCTCCAGGACCTTTGGAAGAATGCTACAGATCCTAAAGTAAAAACCATTTCCAAAGG
TTTTTTTGGTCAAATATACTGCAGATTAATGAAGATAATTCTCCTTTGTAAAATTAGCTATGTGGACACATACCC
TTGTAGGGCTGCGTTTATCTAATAGTACTTGAATGTTGTATGTTTTCACTGTCACTGAGTCAAACCTGGATGAAA
AAAACCTTTAAATGTTCGTCTATACCCTAAGTAAAATGAGGACGAAAGACAAATATTTTGAAAGCCTAGTCCATC
AGAATGTTTCTTTGATTCTAGAAGCTGTTTAATATCACTTATCTACTTCATTGCCTAAGTTCATTTCAAAGAATT
TGTATTTAGAAAAGGTTTATATTATTAGTGAAAACAAAACTAAAGGGAAGTTCAAGTTCTCATGTAATGCCACAT
ATATACTTGAGGTGTAGAGATGTTATTAAGAAGTTTTGATGTTAGAATAATTGCTTTTGGAAAATACCAAATGAA
CGTACAGTACAACATTTCAAGGAAATGAATATATTGTTAGACCAGGTAAGCAAGTTTATTTTTGTTAAAGAGCAC
TTGGTGGAGGTAGTAGGGGCAGGGAAAGGTCAGCATAGGAGAGAAAGTTCATGAATCTGGTAAAACAGTCTCTTG
TTCTTAAGAGGAGATGTAGAAAAATGTGTACAATGTTATTATAAACAGACAAATCACGTCTTACCACATCCATGT
AGCTACTGGTGTTAGAGTCATTAAAATACCTTTTTTTGCATCTTTTTTCAAAGTTTAATGTGAACTTTTAGAAAA
GTGATTAATGTTGCCCTAATACTTTATATGTTTTAATGGATTTTTTTTAAGTATTAGAAAATGACACATAACA
CGGGCAGCTGGTTGCTCATAGGGTCCTTCTCTAGGGAGAAACCATTGTTAATTCAAATAAGCTGATTTTAATGAC
GTTTTCAACTGGTTTTTAAATATTCAATATTGGTCTGTGTTTAAGTTTGTTATTTGAATGTAATTTACATAGAGG
AATATAATAATGGAGAGACTTCAAATGGAAAGACAGAACATTACAAGCCTAATGTCTCCATAATTTTATAAAATG
AAATCTTAGTGTCTAAATCCTTGTACTGATTACTAAAATTAACCCACTCCTCCCCAACAAGGTCTTATAAACCAC
AGCACTTTGTTCCAAGTTCAGAGTTTTAAATTGAGAGCATTAAACATCAAAGTTATAATATCTAAAACAATTTAT
TTTTCATCAATAACTGTCAGAGGTGATCTTTATTTTCTAAATATTTCAAACTTGAAAACAGAGTAAAAAAGTGAT
AGAAAAGTTGCCAGTTTGGGGTTAAAGCATTTTTAAAGCTGCATGTTCCTTGTAATCAAAGAGATGTGTCTGAGA
TCTAATAGAGTAAGTTACATTTATTTTACAAAGCAGGATAAAAATGTGGCTATAATACACACTACCTCCCTTCAC
TACAGAAAGAACTAGGTGGTGTCTACTGCTAGGGAGATTATATGAAGGCCAAAATAATGACTTCAGCAAGAGTGA
CTGAACTCACTCTAAGGCCTTTGACTGCAGAGGCACCTGTTAGGGAAAATCAGATGTCTCATATAATAAGGTGAT
GTCGGAAACACGCAAAACAAAACGAAAAAGATTTCTCAGTATACACAACTGAATGATGATACTTACAATTTTTA
GCAGGTAGCTTTTTAATGTTACAGAAATTTAATTTTTTCTATTTTGAAATTTGAGGCTTGTTTACATTGCTT
AGATAATTTAGAATTTTTAACTAATGTCAAAACTACAGTGTCAAACATTCTAGGTTGTAGTTACTTTCAGAGTAG
ATACAGGGTTTTAGATCATTACAGTTTAAGTTTTCTGACCAATTAAAAAAACATAGAGAACAAAAGCATATTGA
CCAAGCAACAAGCTTATAATTAATTTTTATTAGTTGATTGATTAATGATGTATTGCCTTTTGCCCATATATACCC
TGTGTATCTATACTTGGAAGTGTTTAAGGTTGCCATTGGTTGAAAACATAAGTGTCTCTGGCCATCAAAGTGATC
TTGTTTACAGCAGTGCTTTTGTGAAACAATTATTTATTTGCTGAAAGAGCTCTTCTGAACTGTGTCCTTTTAATT
```

FIGURE 203B

```
TTTGCTTAGAATAGAATGGAACAAGTTTAAATTTCAAGGAAATATGAAGGCACTTCCTTTTTTTCTAAGAAGGAA
GTTGCTAGATGATTCCTTCATCACACTTACTTAAAGTACTGAGAAGAGTATCTGTAAATAAAAGGGTTCCAACCT
TTTAAAAAAGAAGGAAAAAACTTTTTGGTGCTCCAGTGTAGGGCTATCTTTTTAAAAAATGTCAACAAAGGGAAA
ATTAACTATCAGCTTGGATGGTCACTTGAATAGAAGATGGTTATACACAGTGTTATTGTTAAAATTTTTTACCT
TTTGGTTGGTTTGCATCTTTTTTCCATATTGTTAATTTTATACCAAAATGTTAAATATTTGTATTACTTGAATTT
TGCTCTTGTATGGCAAAATAATTAGTGAGTTTAAAAAAAATCTATAGTTTCCAATAAACAACTGAAAAATTAAAA
AAAAAAAAAAAAAAAAAAAAAAAAA
```

FIGURE 204

MRMLVSGRRVKKWQLIIQLFATCFLASLMFFWEPIDNHIVSHMKSYSYRYLINSYDFVNDTLSLKHTSAGPRYQY
LINHKEKCQAQDVLLLLFVKTAPENYDRRSGIRRTWGNENYVRSQLNANIKTLFALGTPNPLEGEELQRKLAWED
QRYNDIIQQDFVDSFYNLTLKLLMQFSWANTYCPHAKFLMTADDDIFIHMPNLIEYLQSLEQIGVQDFWIGRVHR
GAPPIRDKSSKYYVSYEMYQWPAYPDYTAGAAYVISGDVAAKVYEASQTLNSSLYIDDVFMGLCANKIGIVPQDH
VFFSGEGKTPYHPCIYEKMMTSHGHLEDLQDLWKNATDPKVKTISKGFFGQIYCRLMKIILLCKISYVDTYPCRA
AFI

FIGURE 205

TTTTTTTTCATTAAAAAAATAGTGCTCTTTATTATAAATTACTGAAATGTTTCTTTTCTGAATATAAATATAAATA
TGTGCAAAGTTTGACTTGGATTGGGATTTTGTTGAGTTCTTCAAGCATCTCCTAATAGCCTCAAGGGCCTGAGTA
GGGGGGAGGAGAGAGGACTGGAGGTGGAATCTTTATAAAAGACAGAGTGATTGAGGCAGATTGTAAACATTATTA
AAAAACAAGAAACAAACAAAAAAATAGAGAAAAAAACCACCCCAACACACAACTGCCCTGTCCAGCCCAATACCT
GACACAGAATACTTTGTGTTTGTTTAGTTGCCCCCCCCCACATAA

FIGURE 206A

```
CAATTGTCATACGACTTGCAGTGAGCGTCAGGAGCACGTCCAGGAACTCCTCAGCAGCGCCTCCTTCAGCTCCAC
AGCCAGACGCCCTCAGACAGCAAAGCCTACCCCCGCGCCGCGCCCTGCCCGCCGCTCGGATGCTCGCCCGCGCCC
TGCTGCTGTGCGCGGTCCTGGCGCTCAGCCATACAGCAAATCCTTGCTGTTCCCACCCATGTCAAAACCGAGGTG
TATGTATGAGTGTGGGATTTGACCAGTATAAGTGCGATTGTACCCGGACAGGATTCTATGGAGAAAACTGCTCAA
CACCGGAATTTTTGACAAGAATAAAATTATTTCTGAAACCCACTCCAAACACAGTGCACTACATACTTACCCACT
TCAAGGGATTTTGGAACGTTGTGAATAACATTCCCTTCCTTCGAAATGCAATTATGAGTTATGTCTTGACATCCA
GATCACATTTGATTGACAGTCCACCAACTTACAATGCTGACTATGGCTACAAAAGCTGGGAAGCCTTCTCTAACC
TCTCCTATTATACTAGAGCCCTTCCTCCTGTGCCTGATGATTGCCCGACTCCCTTGGGTGTCAAAGGTAAAAAGC
AGCTTCCTGATTCAAATGAGATTGTGGAAAAATTGCTTCTAAGAAGAAAGTTCATCCCTGATCCCCAGGGCTCAA
ACATGATGTTTGCATTCTTTGCCCAGCACTTCACGCATCAGTTTTCAAGACAGATCATAAGCGAGGGCCAGCTT
TCACCAACGGGCTGGGCCATGGGGTGGACTTAAATCATATTTACGGTGAAACTCTGGCTAGACAGCGTAAACTGC
GCCTTTTCAAGGATGGAAAAATGAAATATCAGATAATTGATGGAGAGATGTATCCTCCCACAGTCAAAGATACTC
AGGCAGAGATGATCTACCCTCCTCAAGTCCCTGAGCATCTACGGTTTGCTGTGGGCAGGAGGTCTTTGGTCTGG
TGCCTGGTCTGATGATGTATGCCACAATCTGGCTGCGGAACACAACAGAGTATGCGATGTGCTTAAACAGGAGC
ATCCTGAATGGGGTGATGAGCAGTTGTTCCAGACAAGCAGGCTAATACTGATAGGAGAGACTATTAAGATTGTGA
TTGAAGATTATGTGCAACACTTGAGTGGCTATCACTTCAAACTGAAATTTGACCCAGAACTACTTTTCAACAAAC
AATTCCAGTACCAAAATCGTATTGCTGCTGAATTTAACACCCTCTATCACTGGCATCCCCTTCTGCCTGACACCT
TTCAAATTCATGACCAGAAATACAACTATCAACAGTTTATCTACAACAACTCTATATTGCTGGAACATGGAATTA
CCCAGTTTGTTGAATCATTCACCAGGCAAATTGCTGGCAGGGTTGCTGGTGGTAGGAATGTTCCACCCGCAGTAC
AGAAAGTATCACAGGCTTCCATTGACCAGAGCAGGCAGATGAAATACCAGTCTTTTAATGAGTACCGCAAACGCT
TTATGCTGAAGCCCTATGAATCATTTGAAGAACTTACAGGAGAAAGGAAATGTCTGCAGAGTTGGAAGCACTCT
ATGGTGACATCGATGCTGTGGAGCTGTATCCTGCCCTTCTGGTAGAAAAGCCTCGGCCAGATGCCATCTTTGGTG
AAACCATGGTAGAAGTTGGAGCACCATTCTCCTTGAAAGGACTTATGGGTAATGTTATATGTTCTCCTGCCTACT
GGAAGCCAAGCACTTTTGGTGGAGAAGTGGGTTTTCAAATCATCAACACTGCCTCAATTCAGTCTCTCATCTGCA
ATAACGTGAAGGGCTGTCCCTTTACTTCATTCAGTGTTCCAGATCCAGAGCTCATTAAAACAGTCACCATCAATG
CAAGTTCTTCCCGCTCCGGACTAGATGATATCAATCCCACAGTACTACTAAAAGAACGTTCGACTGAACTGTAGA
AGTCTAATGATCATATTTATTTATTTATATGAACCATGTCTATTAATTTAATTATTTAATAATATTTATATTAAA
CTCCTTATGTTACTTAACATCTTCTGTAACAGAAGTCAGTACTCCTGTTGCGGAGAAAGGAGTCATACTTGTGAA
GACTTTTATGTCACTACTCTAAAGATTTGCTGTTGCTGTTAAGTTTGGAAAACAGTTTTATTCTGTTTTATAA
ACCAGAGAGAAATGAGTTTTGACGTCTTTTTACTTGAATTTCAACTTATATTATAAGAACGAAAGTAAAGATGTT
TGAATACTTAAACACTATCACAAGATGGCAAAATGCTGAAAGTTTTTACACTGTCGATGTTTCCAATGCATCTTC
CATGATGCATTAGAAGTAACTAATGTTTGAAATTTTAAAGTACTTTTGGTTATTTTTCTGTCATCAAACAAAAAC
AGGTATCAGTGCATTATTAAATGAATATTTAAATTAGACATTACCAGTAATTTCATGTCTACTTTTTAAAATCAG
CAATGAAACAATAATTTGAAATTTCTAAATTCATAGGGTAGAATCACCTGTAAAAGCTTGTTTGATTTCTTAAAG
TTATTAAACTTGTACATATACCAAAAAGAAGCTGTCTTGGATTTAAATCTGTAAAATCGATGAAATTTTACTAC
AATTGCTTGTTAAAATATTTATAAGTGATGTTCCTTTTTCACCAAGAGTATAAACCTTTTTAGTGTGACTGTTA
AAACTTCCTTTTAAATCAAATGCCAAATTTATTAAGGTGGTGGAGCCACTGCAGTGTTATCTCAAAATAAGAAT
ATTTTGTTGAGATATTCCAGAATTTGTTTATATGGCTGGTAACATGTAAAATGTATATCAGCAAAAGGGTCTACC
TTTAAAATAAGCAATAACAAAGAAGAAAACCAAATTATTGTTCAAATTTAGGTTTAAACTTTTGAAGCAAACTTT
TTTTTATCCTTGTGCACTGCAGGCCTGGTACTCAGATTTTGCTATGAGGTTAATGAAGTACCAAGCTGTGCTTGA
ATAACGATATGTTTTCTCAGATTTTCTGTTGTACAGTTTAATTTAGCAGTCCATATCACATTGCAAAGTAGCAA
TGACCTCATAAAATACCTCTTCAAAATGCTTAAATTCATTTCACACATTAATTTTATCTCAGTCTTGAAGCCAAT
TCAGTAGGTGCATTGGAATCAAGCCTGGCTACCTGCATGCTGTTCCTTTCTTTTCTTCTTTTAGCCATTTTGCT
AAGAGACACAGTCTTCTCATCACTTCGTTTCTCCTATTTTGTTTTACTAGTTTTAAGATCAGAGTTCACTTTCTT
TGGACTCTGCCTATATTTTCTTACCTGAACTTTTGCAAGTTTTCAGGTAAACCTCAGCTCAGGACTGCTATTTAG
CTCCTCTTAAGAAGATTAAAAGAGAAAAAAAAGGCCCTTTTAAAAATAGTATACACTTATTTTAAGTGAAAAGC
AGAGAATTTTATTTATAGCTAATTTTAGCTATCTGTAACCAAGATGGATGCAAAGAGGCTAGTGCCTCAGAGAGA
ACTGTACGGGGTTTGTGACTGGAAAAAGTTACGTTCCCATTCTAATTAATGCCCTTTCTTATTTAAAAACAAAAC
```

FIGURE 206B

```
CAAATGATATCTAAGTAGTTCTCAGCAATAATAATAATGACGATAATACTTCTTTTCCACATCTCATTGTCACTG
ACATTTAATGGTACTGTATATTACTTAATTTATTGAAGATTATTATTTATGTCTTATTAGGACACTATGGTTATA
AACTGTGTTTAAGCCTACAATCATTGATTTTTTTTGTTATGTCACAATCAGTATATTTTCTTTGGGGTTACCTC
TCTGAATATTATGTAAACAATCCAAAGAAATGATTGTATTAAGATTTGTGAATAAATTTTTAGAAATCTGATTGG
CATATTGAGATATTTAAGGTTGAATGTTTGTCCTTAGGATAGGCCTATGTGCTAGCCCACAAAGAATATTGTCTC
ATTAGCCTGAATGTGCCATAAGACTGACCTTTTAAAATGTTTTGAGGGATCTGTGGATGCTTCGTTAATTTGTTC
AGCCACAATTTATTGAGAAAATATTCTGTGTCAAGCACTGTGGGTTTAATATTTTAAATCAAACGCTGATTAC
AGATAATAGTATTTATATAAATAATTGAAAAAAATTTTCTTTTGGGAAGAGGGAGAAAATGAAATAAATATCATT
AAAGATAACTCAGGAGAATCTTCTTTACAATTTTACGTTTAGAATGTTTAAGGTTAAGAAAGAAATAGTCAATAT
GCTTGTATAAAACACTGTTCACTGTTTTTTTTAAAAAAAAAACTTGATTTGTTATTAACATTGATCTGCTGACAA
AACCTGGGAATTTGGGTTGTGTATGCGAATGTTTCAGTGCCTCAGACAAATGTGTATTTAACTTATGTAAAAGAT
AAGTCTGGAAATAAATGTCTGTTTATTTTTGTACTATTTA
```

FIGURE 207

MLARALLLCAVLALSHTANPCCSHPCQNRGVCMSVGFDQYKCDCTRTGFYGENCSTPEFLTRIKLFLKPTPNTVH
YILTHFKGFWNVVNNIPFLRNAIMSYVLTSRSHLIDSPPTYNADYGYKSWEAFSNLSYYTRALPPVPDDCPTPLG
VKGKKQLPDSNEIVEKLLLRRKFIPDPQGSNMMFAFFAQHFTHQFFKTDHKRGPAFTNGLGHGVDLNHIYGETLA
RQRKLRLFKDGKMKYQIIDGEMYPPTVKDTQAEMIYPPQVPEHLRFAVGQEVFGLVPGLMMYATIWLREHNRVCD
VLKQEHPEWGDEQLFQTSRLILIGETIKIVIEDYVQHLSGYHFKLKFDPELLFNKQFQYQNRIAAEFNTLYHWHP
LLPDTFQIHDQKYNYQQFIYNNSILLEHGITQFVESFTRQIAGRVAGGRNVPPAVQKVSQASIDQSRQMKYQSFN
EYRKRFMLKPYESFEELTGEKEMSAELEALYGDIDAVELYPALLVEKPRPDAIFGETMVEVGAPFSLKGLMGNVI
CSPAYWKPSTFGGEVGFQIINTASIQSLICNNVKGCPFTSFSVPDPELIKTVTINASSSRSGLDDINPTVLLKER
STEL

FIGURE 208

AGCAGAGCACACAAGCTTCTAGGACAAGAGCCAGGAAGAAACCACCGGAAGGAACCATCTCACTGTGTGTAAACA
TGACTTCCAAGCTGGCCGTGGCTCTCTTGGCAGCCTTCCTGATTTCTGCAGCTCTGTGTGAAGGTGCAGTTTTGC
CAAGGAGTGCTAAAGAACTTAGATGTCAGTGCATAAAGACATACTCCAAACCTTTCCACCCCAAATTTATCAAAG
AACTGAGAGTGATTGAGAGTGGACCACACTGCGCCAACACAGAAATTATTGTAAAGCTTTCTGATGGAAGAGAGC
TCTGTCTGGACCCCAAGGAAAACTGGGTGCAGAGGGTTGTGGAGAAGTTTTTGAAGAGGGCTGAGAATTCATAAA
AAAATTCATTCTCTGTGGTATCCAAGAATCAGTGAAGATGCCAGTGAAACTTCAAGCAAATCTACTTCAACACTT
CATGTATTGTGTGGGTCTGTTGTAGGGTTGCCAGATGCAATACAAGATTCCTGGTTAAATTTGAATTTCAGTAAA
CAATGAATAGTTTTTCATTGTACCATGAAATATCCAGAACATACTTATATGTAAAGTATTATTTATTTGAATCTA
CAAAAAACAACAAATAATTTTTAAATATAAGGATTTTCCTAGATATTGCACGGGAGAATATACAAATAGCAAAAT
TGAGCCAAGGGCCAAGAGAATATCCGAACTTTAATTTCAGGAATTGAATGGGTTTGCTAGAATGTGATATTTGAA
GCATCACATAAAAATGATGGGACAATAAATTTTGCCATAAAGTCAAATTTAGCTGGAAATCCTGGATTTTTTTCT
GTTAAATCTGGCAACCCTAGTCTGCTAGCCAGGATCCACAAGTCCTTGTTCCACTGTGCCTTGGTTTCTCCTTTA
TTTCTAAGTGGAAAAAGTATTAGCCACCATCTTACCTCACAGTGATGTTGTGAGGACATGTGGAAGCACTTTAAG
TTTTTTCATCATAACATAAATTATTTTCAAGTGTAACTTATTAACCTATTTATTATTTATGTATTTATTTAAGCA
TCAAATATTTGTGCAAGAATTTGGAAAAATAGAAGATGAATCATTGATTGAATAGTTATAAAGATGTTATAGTAA
ATTTATTTTATTTTAGATATTAAATGATGTTTTATTAGATAAATTTCAATCAGGGTTTTTAGATTAAACAAAGAA
ACAATTGGGTACCCAGTTAAATTTTCATTTCAGATAAACAACAAATAATTTTTTAGTATAAGTACATTATTGTTT
ATCTGAAAGTTTTAATTGAACTAACAATCCTAGTTTGATACTCCCAGTCTTGTCATTGCCAGCTGTGTTGGTAGT
GCTGTGTTGAATTACGGAATAATGAGTTAGAACTATTAAAACAGCCAAAACTCCACAGTCAATATTAGTAATTTC
TTGCTGGTTGAAACTTGTTTATTATGTACAAATAGATTCTTATAATATTATTTAAATGACTGCATTTTAAATAC
AAGGCTTTATATTTTTAACTTTAAGATGTTTTTATGTGCTCTCCAAATTTTTTTTACTGTTTCTGATTGTATGGA
AATATAAAAGTAAATATGAAACATTTAAAATATAATTTGTTGTCAAAGTAAAAAAAAAAAAAAAA

FIGURE 209

MTSKLAVALLAAFLISAALCEGAVLPRSAKELRCQCIKTYSKPFHPKFIKELRVIESGPHCANTEIIVKLSDGRE
LCLDPKENWVQRVVEKFLKRAENS

FIGURE 210

CTGAGGCCCACGCAGGGCCTAGGGTGGGAAGATGGCAGGTGGGGGCGGCGACCTGAGCACCAGGAGGCTGAATGA
ATGTATTTCACCAGTAGCAAATGAGATGAACCATCTTCCTGCACACAGCCACGATTTGCAAAGGATGTTCACGGA
AGACCAGGGTGTAGATGACAGGCTGCTCTATGACATTGTATTCAAGCACTTCAAAAGAAATAAGGTGGAGATTTC
AAATGCAATAAAAAAGACATTTCCATTCCTCGAGGGCCTCCGTGATCGTGATCTCATCACAAATAAAATGTTTGA
AGATTCTCAAGATTCTTGTAGAAACCTGGTCCCTGTACAGAGAGTGGTGTACAATGTTCTTAGTGAACTGGAGAA
GACATTTAACCTGCCAGTTCTGGAAGCACTGTTCAGCGATGTCAACATGCAGGAATACCCCGATTTAATTCACAT
TTATAAAGGCTTTGAAAATGTAATCCATGACAAATTGCCTCTCCAAGAAAGTGAAGAAGAAGAGAGGGAGGAGAG
GTCTGGCCTCCAACTAAGTCTTGAACAAGGAACTGGTGAAAACTCTTTTCGAAGCCTGACTTGGCCACCTTCGGG
TTCCCCATCTCATGCTGGTACAACCCCACCTGAAAATGGACTCTCAGAGCACCCCTGTGAAACAGAACAGATAAA
TGCAAAGAGAAAAGATACAACCAGTGACAAAGATGATTCGCTAGGAAGCCAACAAACAAATGAACAATGTGCTCA
AAAGGCTGAGCCAACAGAGTCCTGCGAACAAATTGCTGTCCAAGTGAATAATGGGGATGCTGGAAGGGAGATGCC
CTGCCCGTTGCCCTGTGATGAAGAAAGCCCAGAGGCAGAGCTACACAACCATGGAATCCAAATTAATTCCTGTTC
TGTGCGACTGGTGGATATAAAAAAGGAAAAGCCATTTTCTAATTCAAAAGTTGAGTGCCAAGCCCAAGCAAGAAC
TCATCATAACCAGGCATCTGACATAATAGTCATCAGCAGTGAGGACTCTGAAGGATCCACTGACGTTGATGAGCC
CTTAGAAGTCTTCATCTCAGCACCGAGAAGTGAGCCTGTGATCAATAATGACAACCCTTTAGAATCAAATGATGA
AAAGGAGGGCCAAGAAGCCACTTGCTCACGACCCCAGATTGTACCAGAGCCCATGGATTTCAGAAAATTATCTAC
ATTCAGAGAAAGTTTTAAGAAAAGAGTGATAGGACAAGACCACGACTTTTCAGAATCCAGTGAGGAGGAGGCGCC
CGCAGAAGCCTCAAGCGGGGCACTGAGAAGCAAGCATGGTGAGAAGGCTCCTATGACTTCTAGAAGTACATCTAC
TTGGAGAATACCCAGCAGGAAGAGACGTTTCAGCAGTAGTGACTTTTCAGACCTGAGTAATGGAGAAGAGCTTCA
GGAAACCTGCAGCTCATCCCTAAGAAGAGGGTCAGGATCACAGCCACAAGAACCTGAAAATAAGAAGTGCTCCTG
TGTCATGTGTTTTCCAAAAGGTGTGCCAAGAAGCCAAGAAGCAAGGACTGAAAGTAGTCAAGCATCTGACATGAT
GGATACCATGGATGTTGAAAACAATTCTACTTTGGAAAAACACAGTGGGAAAAGAAGAAAAAAGAGAAGGCATAG
ATCTAAAGTAAATGGTCTCCAAAGAGGGAGAAAGAAAGACAGACCTAGAAAACATTTAACTCTGAATAACAAAGT
CCAAAAGAAAAGATGGCAACAAAGAGGAAGAAAAGCCAACACTAGACCTTTGAAAAGAAGAAGAAAAAGAGGTCC
AAGAATTCCCAAAGATGAAAATATTAATTTTAAACAATCTGAACTTCCTGTGACCTGTGGTGAGGTGAAGGGCAC
TCTATATAAGGAGCGATTCAAACAAGGAACCTCAAAGAAGTGTATACAGAGTGAGGATAAAAAGTGGTTCACTCC
CAGGGAATTTGAAATTGAAGGAGACCGCGGAGCATCCAAGAACTGGAAGCTAAGTATACGCTGCGGTGGATATAC
CCTGAAAGTCCTGATGGAGAACAAATTTCTGCCAGAACCACCAAGCACAAGAAAAAAGAGAATACTGGAATCTCA
CAACAATACCTTAGTTGACCCTTGTGAGGAGCATAAGAAGAAGAACCCAGATGCTTCAGTCAAGTTCTCAGAGTT
TTTAAAGAAGTGCTCAGAGACATGGAAGACCATTTTTGCTAAAGAGAAAGGAAAATTTGAAGATATGGCAAAGGC
GGACAAGGCCCATTATGAAAGAGAAATGAAAACCTATATCCCTCCTAAAGGGGAGAAAAAAAAGAAGTTCAAGGA
TCCCAATGCACCCAAGAGGCCTCCTTTGGCCTTTTTCCTGTTCTGCTCTGAGTATCGCCCAAAAATCAAAGGAGA
ACATCCTGGCCTGTCCATTGATGATGTTGTGAAGAAACTGGCAGGGATGTGGAATAACACCGCTGCAGCTGACAA
GCAGTTTTATGAAAAGAAGGCTGCAAAGCTGAAGGAAAAATACAAAAAGGATATTGCTGCATATCGAGCTAAAGG
AAAAGCCTAATTCAGCAAAAAAGAGAGTTGTCAAGGCTGAAAAAAGCAAGAAAAAGAAGGAAGAGGAAGAAGATGA
AGAGGATGAACAAGAGGAGGAAAATGAAGAAGATGATGATAAATAAGTTGCTTCTAGTGCAGTTTTTTCTTGTC
TATAAAGCATTTAAGCTGCCTGTACACAACTCACTCCTTTTAAAGAAAAAAACTTCAACGTAAGACTGTGTAAGA
TTTGTTTTTAAACCGTACACTGTGTTTTTTGTATAGTTAACCACTACCGAATGTGTCTTCAGATAGCCCTGTCC
TGGTGGTATTTAGCCACTAACCTTTGCCTGGTACAGTATGGGGGTTGTAAATTGGCATGGAAATTTAAAGCAGGT
TCTTGTTAGTGCACAGCACAAATTAGTTGTATAGGAGGATGGTAGTTTTTTCACCTTCAGTTGTCTCTGATGTAG
CTTATACAAAACATTTGTTGTTCTGTTAACTGAATGCCACTCTGTAATTGCAAAAAAAAAAAAACAGTTGCAGCTG
TTTTGTTGACATTCTGAATGCTTCTAAGTAAATACAATTTTTAAAAAACCGTATGAGGGAACTGTGTAGACAAGG
TACCAGGTCAGTCTTCTTCGATGTTCTATTAGCTCCACAAAGCCAATCTCAATCCCTCAAAACAATCTTGTCATA
CTTGAAAATATGACACTCTAGTCAAAGCCTTGGTAAAATAATCAGTGTTTCCAATCTGTCCTGTTACAAAAGAAA
CAGATTATTATTGAACTTATGCAAATAACCATTGTCATAAGAATGTTTATGAATAGTTTCCAAATTATGGCAAAT
TCATGTAGAGAGAGAAAAGTAACTGTTTTGGTTTTGCTCACAAAAGTCTACTTTACCTAAGGGCTGTCAGATATA
AGTAACTTAAAAGAAAGAGAAGTTTTCTTGACTTTTGAAAACAAAATATGAAAAGAATCGGCAATGTTTCAAACA
AAAAGTCATAAAAGTCACTTTATTCCTCCATCAAAAAAAAAAAAAAAAAAAAAA

FIGURE 211

MAGGGGDLSTRRLNECISPVANEMNHLPAHSHDLQRMFTEDQGVDDRLLYDIVFKHFKRNKVEISNAIKKTFPFL
EGLRDRDLITNKMFEDSQDSCRNLVPVQRVVYNVLSELEKTFNLPVLEALFSDVNMQEYPDLIHIYKGFENVIHD
KLPLQESEEEEREERSGLQLSLEQGTGENSFRSLTWPPSGSPSHAGTTPPENGLSEHPCETEQINAKRKDTTSDK
DDSLGSQQTNEQCAQKAEPTESCEQIAVQVNNGDAGREMPCPLPCDEESPEAELHNHGIQINSCSVRLVDIKKEK
PFSNSKVECQAQARTHHNQASDIIVISSEDSEGSTDVDEPLEVFISAPRSEPVINNDNPLESNDEKEGQEATCSR
PQIVPEPMDFRKLSTFRESFKKRVIGQDHDFSESSEEEAPAEASSGALRSKHGEKAPMTSRSTSTWRIPSRKRRF
SSSDFSDLSNGEELQETCSSSLRRGSGSQPQEPENKKCSCVMCFPKGVPRSQEARTESSQASDMMDTMDVENNST
LEKHSGKRRKKRRHRSKVNGLQRGRKKDRPRKHLTLNNKVQKKRWQQRGRKANTRPLKRRRKRGPRIPKDENINF
KQSELPVTCGEVKGTLYKERFKQGTSKKCIQSEDKKWFTPREFEIEGDRGASKNWKLSIRCGGYTLKVLMENKFL
PEPPSTRKKRILESHNNTLVDPCEEHKKKNPDASVKFSEFLKKCSETWKTIFAKEKGKFEDMAKADKAHYEREMK
TYIPPKGEKKKKFKDPNAPKRPPLAFFLFCSEYRPKIKGEHPGLSIDDVVKKLAGMWNNTAAADKQFYEKKAAKL
KEKYKKDIAAYRAKGKPNSAKKRVVKAEKSKKKKEEEEDEEDEQEEENEEDDDK

FIGURE 212

```
GGGGAAGTCGAGGCGGGAGTGACTCTGCTTCCGTTTCTGGTTTTGCTCTAGTGTTTGGGTTTCTTCGCGGCTGCT
CAAGATGAACCGACTCTTCGGGAAAGCGAAACCCAAGGCTCCGCCGCCCAGCCTGACTGGCTGCATTGGCACGGT
GGACAGTAGAGCAGAATCCATTGACAAGAAGATTTCTCGATTGGATGCTGAGCTAGTGAAGTATAAGGATCAGAT
CAAGAAGATGAGAGAGGGTCCTGCAAAGAATATGGTCAAGCAGAAAGCCTTGCGAGTTTTAAAGCAAAAGAGGAT
GTATGAGCAGCAGCGGGACAATCTTGCCCAACAGTCATTCAACATGGAACAAGCCAATTATACCATCCAGTCTTT
GAAGGACACCAAGACCACGGTTGATGCTATGAAACTGGGAGTAAAGGAAATGAAGAAGGCATACAAGCAAGTGAA
GATCGACCAGATTGAGGATTTACAAGACCAGCTAGAGGATATGATGGAAGATGCAAATGAAATCCAAGAAGCACT
GAGTCGCAGTTATGGCACCCCAGAACTGGATGAAGATGATTTAGAAGCAGAGTTGGATGCACTAGGTGATGAGCT
TCTGGCTGATGAAGACAGTTCTTATTTGGATGAGGCAGCATCTGCACCTGCAATTCCAGAAGGTGTTCCCACTGA
TACAAAAAACAAGGATGGAGTTCTGGTGGATGAATTTGGATTGCCACAGATCCCTGCTTCATAGATTTGCATCAT
TCAAGCATATCTTGTAAAACAAACACATATTATGGGACTAGGAAATATTTATCTTTCCAAATTTGCCATAACAGA
TTTAGGTTTCTTTCCTTTCTTTGAAGGAAAGTTTAATTACATTGCTCTTTTATTTTTTCCATTAAGAGACTCATT
GCTTGGGAAATGCTTTCTTCGTACTAAAATTTGATTCCTTTTTTTCTTATGAAAAACGAACTCAGTTTAAAAGTA
TTTTTAGCTCGTATGACTTGTTTTCATTCATTAATAATAATTTGAAATAAAACTAAGGAAATGGAATCTTAAAAG
TCTATGACAGTGTAACTCTACAGTCTCAAAATGACCTGATAAATTGATAAGACAAAGATGAGATTATTGGGGCTG
TTCATATTATGATTCAGAATCATTTTCTATTGTGGTATTATAGGTTGGTTAAAGTGATGGCCTTTTTGATGGGTT
TTGTTGTGTCTTGTGAACAAGTCGTTACTGTGTCCATTATTGGAATGGAATTATCACTACTGTATCATGAGTGGG
TATTTTGATTCTATGGTTCCCTCAGTATTACATCTTGACTTGTAATCAATTATGAATATTTCTTGATATTTAATG
TATAGGACATTTATTTATACTCAATAAATATTTTCAAAAGGAAAAAAAAAAAAATCAAAAAAAAAAAAAAAAAA
AAAAAAAA
```

FIGURE 213

MNRLFGKAKPKAPPPSLTGCIGTVDSRAESIDKKISRLDAELVKYKDQIKKMREGPAKNMVKQKALRVLKQKRMY
EQQRDNLAQQSFNMEQANYTIQSLKDTKTTVDAMKLGVKEMKKAYKQVKIDQIEDLQDQLEDMMEDANEIQEALS
RSYGTPELDEDDLEAELDALGDELLADEDSSYLDEAASAPAIPEGVPTDTKNKDGVLVDEFGLPQIPAS

FIGURE 214

CCTCTTCTCTTCTCGCTTGGGAACGCCGGTCTCACCTCGGCTTGCAATGGACCCCAACTGCTCCTGCGCCGCTGG
AGGCTCCTACGCCTGCGCCGGCTCCTGCAAGTGCAAAAAGTGCAAATGCACCTCCTGCAAGAAGAGCTGCTGCTC
CTGTTGCCCCCTGGGCTGTGCCAAGTGTGCCCAGGGCTGCATCCGCAAAGGGGCTTCGGAAAAGTGCAGCTGCTG
TGCCTGATGTCGGGACTGCCCTGCTCTCGGATGAAAACAGAATGACACGTAAAGTCCGGGATTTTTTTTTCTACA
ACTCCGACTCATTTGC

FIGURE 215

MDPNCSCAAGGSYACAGSCKCKKCKCTSCKKSCCSCCPLGCAKCAQGCIRKGASEKCSCCA

FIGURE 216

```
GAATATAAAGTGCACTAATGAAAGTGTAATGCGCTTGGAATCATCCCATAGAAGCGCATACGCCTGTTGCGTTCA
GCGGGTCCATGTGCTTCCACAAAACCCGGTCCCTGGTGCCATAAAGGTTGTGGGACCACTGTTTAGCCAGGATGC
ATAGCATGGGTTTATGAATTCCCTATCTTTGCAGCACATCCTTTATTTCTGGCTTGCATGGGACTTGAAAGCCTA
AAACAACTAAATGCTAAGAAAAATTATTTTTAAAATTATGACAAAAATATTTTCTATTTCAGATGTATAGATCTG
CAATCCAGAAACTATGAATTTTTTTCAGTTGAGTAGTCTGTTTGCCAAAAAAT
```

FIGURE 217

NIKCTNESVMRLESSHRSAYACCVQRVHVLPQNPVPGAIKVVGPLFSQDA

FIGURE 218

```
GAATTCGGCACGAGCTCTTCTCCCCTGATTCAAGACTCCTCTGCTTTGGACTGAAGCACTGCAGGAGTTTGTGAC
CAAGAACTTCAAGAGTCAAGACAGAAGGAAGCCAAGGGAGCAGTGCAATGGATTTCTCAGTAAAGGTAGACATAG
AGAAGGAGGTGACCTGCCCCATCTGCCTGGAGCTCCTGACAGAACCTCTGAGCCTAGATTGTGGCCACAGCTTCT
GCCAAGCCTGCATCACTGCAAAGATCAAGGAGTCAGTGATCATCTCAAGAGGGGAAAGCAGCTGTCCTGTGTGTC
AGACCAGATTCCAGCCTGGGAACCTCCGACCTAATCGGCATCTGGCCAACATAGTTGAGAGAGTCAAAGAGGTCA
AGATGAGCCCACAGGAGGGGCAGAAGAGAGATGTCTGTGAGCACCATGGAAAAAAACTCCAGATCTTCTGTAAGG
AGGATGGAAAAGTCATTTGCTGGGTTTGTGAACTGTCTCAGGAACACCAAGGTCACCAAACATTCCGCATAAACG
AGGTGGTCAAGGAATGTCAGGAAAAGCTGCAGGTAGCCCTGCAGAGGCTGATAAAGGAGGATCAAGAGGCTGAGA
AGCTGGAAGATGACATCAGACAAGAGAGAACCGCCTGGAAGATCGAGAGACAGAAGATTCTGAAAGGGTTCAATG
AAATGAGAGTCATCTTGGACAATGAGGAGCAGAGAGAGCTGCAAAAGCTGGAGGAAGGTGAGGTGAATGTGCTGG
ACAACCTGGCAGCAGCTACAGACCAGCTGGTCCAGCAGAGGCAGGATGCCAGCACGCTCATCTCAGATCTCCAGC
GGAGGTTGACGGGATCGTCAGTAGAGATGCTGCAGGATGTGATTGACGTCATGAAAAGGAGTGAAAGCTGGACAT
TGAAGAAGCCAAAATCTGTTTCCAAGAAACTAAAGAGTGTATTCCGAGTACCAGATCTGAGTGGGATGCTGCAAG
TTCTTAAAGAGCTGACAGATGTCCAGTACTACTGGGTGGACGTGATGCTGAATCCAGGCAGTGCCACTTCGAATG
TTGCTATTTCTGTGGATCAGAGACAAGTGAAAACTGTACGCACCTGCACATTTAAGAATTCAAATCCATGTGATT
TTTCTGCTTTTGGTGTCTTCGGCTGCCAATATTTCTCTTCGGGGAAATATTACTGGGAAGTAGATGTGTCTGGAA
AGATTGCCTGGATCCTGGGCGTACACAGTAAAATAAGTAGTCTGAATAAAAGGAAGAGCTCTGGGTTTGCTTTTG
ATCCAAGTGTAAATTATTCAAAAGTTTACTCCAGATATAGACCTCAATATGGCTACTGGGTTATAGGATTACAGA
ATACATGTGAATATAATGCTTTTGAGGACTCCTCCTCTTCTGATCCCAAGGTTTTGACTCTCTTTATGGCTGTGC
TCCCTGTCGTATTGGGGTTTTCCTAGACTATGAGGCAGGCATTGTCTCATTTTTCAATGTCACAAACCACGGAGC
ACTCATCTACAAGTTCTCTGGATGTCGCTTTCTCGACCTGCTTATCCGTATTTCAATCCTTGGAACTGCCTAGT
CCCCATGACTGTGTGCCCACCGAGCTCCTGAGTGTTCTCATTCCTTTACCCACTTCTGCATAGTAGCCCTTGTGC
TGAGACTCAGATTCTGCACCTGAGTTCATCTCTACTGAGACCATCTCTTCCTTTCTTTCCCCTTCTTTTACTTAG
AATGTCTTTGTATTCATTTGCTAGGGCTTCCATAGCAAAGCATCATAGATTGCTGATTTAAACTGTAATTGTATT
GCCGTACTGTGGGCTGGAAATCCCAAATCTAGATTCCAGCAGAGTTGGTTCTTTCTGAGGTCTGCAAGGAAGGGC
TCTGTTCCATGCCTCTCTCCTTGGCTTGTAGAAGGCATCTTGTCCCTATGACTCTTCACATTGTCTTTATGTACA
TCTCTGTGCCCAAGTTTTCCCTTTTTATTAAGACACCAGTCATACTGGCTCAGGGCCCACCGCTAATGCCTTAAT
GAAATCATTTTAACATTATATTCTCTACAAAGACCTTATTTCCAAATAAGATAATATTTGGAGGTATTGGGAATA
AAATTTGAGGAAGGCACGATTTCACTCATAACAATCTTACCCTTTCTTGCAAGAGATGCTTGTACATTATTTCC
TAATACCTTGGTTTCACTAGTAGTAAACATTATTATTTTTTTATATTTGCAAAGGAAACATATCTAATCCTTCC
TATAGAAAGAACAGTATTGCTGTAATTCCTTTTCTTTTCTTCCTCATTTCCTCTGCCCCTTAAAAGATTGAAGAA
AGAGAAACTTGTCAACTCATATCCACGTTATCTAGCAAAAGTCATAAGAATCTATCACTAAGTAATGTATCCTTC
AGAATGTGTTGGTTTACCAGTGACACCCCATATTCATCACAAAATTAAAGCAAGAAGTCCATAGTAATTTATTTG
CTAATAGTGGATTTTTAATGCTCAGAGTTTCTGAGGTCAAATTTATCTTTTCACTTACAAGCTCTATGATCTTA
AATAATTTACTTAATGTATTTGGTGTATTTTCCTCAAATTAATATTGGTGTTCAAGACTATATCTAATTCCTCT
GATCACTTTGAGAAACAAACTTTTATTAAATGTAAGGCACTTTTCTATGAATTTTAAATATAAAAATAAATATTG
TTCTGATTATTACTGAAAAGATGTCAGCCATTTCAATGTCTTGGGAAACAATTTTTTGTTTTGTTCTGTTTTCT
TTTTGCTTCAATAAAACAATAGCTGGCTCTAAAAAAAAAA
```

FIGURE 219

MDFSVKVDIEKEVTCPICLELLTEPLSLDCGHSFCQACITAKIKESVIISRGESSCPVCQTRFQPGNLRPNRHLA
NIVERVKEVKMSPQEGQKRDVCEHHGKKLQIFCKEDGKVICWVCELSQEHQGHQTFRINEVVKECQEKLQVALQR
LIKEDQEAEKLEDDIRQERTAWKIERQKILKGFNEMRVILDNEEQRELQKLEEGEVNVLDNLAAATDQLVQQRQD
ASTLISDLQRRLTGSSVEMLQDVIDVMKRSESWTLKKPKSVSKKLKSVFRVPDLSGMLQVLKELTDVQYYWVDVM
LNPGSATSNVAISVDQRQVKTVRTCTFKNSNPCDFSAFGVFGCQYFSSGKYYWEVDVSGKIAWILGVHSKISSLN
KRKSSGFAFDPSVNYSKVYSRYRPQYGYWVIGLQNTCEYNAFEDSSSSDPKVLTLFMAVLPVVLGFS

FIGURE 220

```
AAGGCAGAGATTTGAACAGAGGGTTGGGTTATCTGGCTCCAAAACCCCTGTCCTTTTCTTGCTATTTCTCTACCT
GGAGTTTGCCAACTGAGCAAGCCCACTCTGGTGGAACCAGCCACTGCAAATNCTTTGTGTCTTNCCAGAGAATAC
CAACATTTCAGTTTTGAGTGAGGGAACGTTGGCTCTGACTGCCTTTGCGNGNNGGAGNNGNCNACNNNNNNNNNN
NNNNNNNNNNNNNNNNNNNNNNNNNNNNNNNNNNNNNNNNNNNNNNNNNNNNNNNNNNNNNNNNCTAAGAAACTGCAT
GTTAAGATTCCACCTACTGAATCATGAGCGGAGGAAGTCGTGGGACACTGGCTGGTGGAGAAGCCATCTAGCATA
TTATTCAAGATGACACCAGCTCCAAGTCTGGAATGAGTCTGTGGGAAACCAAGGTACTTCTTGGACATTCACCTA
TAACTCACGTGTTTCGTGGACTGGTCACAGTGGTTCGGATAAATTGAACAGAACTTTATGAACACCTCCCAGCAC
CAGGTGTTGTTATAGAAACTAAGAACAGAGCAATGAGAAGGACCCAACTCCTGCTCTCAAATGGATGCAGTGGAA
AATAAGCAGACTTTGAACCATTGGTTAGTCAGAAGAGACTTGGGAGACTGAAAACTTGTTTCAACTTGGGCCAGA
ACAAAAAATTAGGAAGCAACACTTGCTGCCAACATGATTTACAAGTGCCAGCACCTTCACCTCTGTTACTTCCTT
CTCACTACACACTGAAAGCAGTTGCTCTTGTTTTACATGGACNNNNNNNNNNNNNNNNNNNNNNNNNNNNNNNNN
NNNNNNNNAGTGGAATTGAGATTGAATCAGTTCCAACTGACTTGCAATCTTGTGCTTTTCAGACGATCCCACTAA
TTGTCCATATCTGTTCCAAAGCCAAATCAAGAGGAACAAGAGCAAAATCTGTCCTCTCATATTATTCATGGTCCT
GCGTGGATCATAAATGGCATGCTGACTGTCTGATGGAGACTTACTTTTCCCTTCCCCCTGGACACCTGCCATGGC
AATGACAGAGGCTGTATTTACTGAAGTGGAGGGAAGAGGTGAATGCAAATGCCTAGGGCCTAAGTATACAGGAA
GGTGTAGGGAGAGGTAAGCAGTGTGTATGTGGAGGAGATAGCAGACGTAAGCAGAGAGAAATCAGAGAGCTTAGT
TCTTCCTCTGGGGCGCACTTGTGGTTAATTAGGACATGCAAATGAGCTAGAAGCTCATTTAATATCCTCCCTGA
CATGTAGCCCCACCCCACCCTGCCCCACTTCCCTGGCAGGTACAAGGGCCACCTGATTGGCCCAGGTATCTGTGG
AAGGTTCCACCTGCTTCTTTGTGGCCCAGGGAACAGAAAAGAGTCCCTGCTGGGCATGGCTAGTGGGGCCGGCCT
GGTCTCCCTCCTCCCTTTCTCTTCCCAACCTTTCAGACTTGGGACCTCTCTTTTCCCTCTCCCTCAGACACTTCC
CTTGTGCCCCGCCCCTCAGGGTGATCTCTGAACCCAAACTTGCCCCAAAGAAGGTTGCTCTGTCCTCTCCACATC
CCCATCTCCTCCCTAGGGCCTTGTTGGGGAGAGGCTCCTCCATCTTTCCCAAGTCACACCATCGTTTCCTACGTG
GTCTGGACAAGAGCAAGAGCACACCTTGTCCCCACCTTCTCCAGAGCAGCCAGAACCCACCTCAGGTGCCTTCCC
CATCCGGTGCAGTTAAGGCACTTCTGCCAGCACCATGGTATGAGCACTAGACTTGGAGTTAAGATTTGAGAGCCC
CCTCTGTCACTGTGGAAGCTTGAGCATGTTGCTTGATCTCTCTGAACCTTGTGTTTCTCATCTGTGAAAGGTGAT
AATGTGGGGCTGCTGTGAGATTTAAAGGACATAATGCACCTACGGTCCAAGCACTGCCTGGAATACAGCAGAAGC
TCAGCAGATACTGGACAACCCATCCCCTTAGTAGAGGCACTAACCATGTGACCCAAGGCAAAAGTGCTTAAGAAA
AAGTGCTTTCTCTGAGCGTTGGTCTCTTCTTCTGTCGAAACATTTATATTGATTTAATATCTCACAGGATTGTAG
CAAGGGTCAGAGAAGACAATAGGTGACATGTTTTTGTACACTGTATACTAGCCACCCAGATGGGCTGTTATTTGC
TAAATGGCAAATTTACACTGTTCCCCAAAGGATGACATGCACTGGGGAGGCGGGGGGTGTGGAGGTGGAGAAAGG
CTGAGCTTGGAGAAAAGGTGCTTGAGGACCCCACTGCCTAAGGACCTGCTCTAGGAAACATTCCCACTCCCTACA
CCCTAGCTGCCCCTCACAGTCAACCCTTAAGGACCTCAAATTCTTGGCAAGGGGTAAAGAGTTGAAAGTGCCAAG
TCCTAGTGGTTTTGAGAAGCCTCTGGTCTGCTCTTTCTGCTCTGTAAAGTCTTAGTTGCCAGAGTCCCCTATAGC
CCCCACATCGCTCCCTTCCTCCTGCCCTCCGGCCACCCTGGAAACTAATGGCCTAAAGGTGCTGTGGCTGTCCTC
CTAAAATCCATTCCCTCCTGATGGGGTGGAGGAATCTGTGAAGCCCACCTTCAGGAGAGGTCTCGGGGCTCGGGC
TGGTGCTGCCAGAGAAAGGGTGACTGAACCAGAAAGGCCTAGGGGAAAGCAGCTCAAACTGCAGCCATCCCCTTA
GTACGATTACTAGGATGTCCCTTGCCTTCCTTTTGCCTCCTCCACCCAACCCCTAAAATAAACAGTATGATGAAA
CCTCTCTTCCAGATTCCCTCT
```

FIGURE 221A

```
CCTCTCACCCTTTAGCCCAGAACTGCTTTGAATACACCAATTGCTGTGGGGCGGCTCGAGGAAGAGAAGACACCA
GTGCCTCAGAAACTGCTCGGTCAGACGGTGATAGCGAGCCACGCATTCACAGGGCCACTGCTGCTCACAGAAGCA
GTGAGGATGATGCCAGGATGATGTCTGCCTCGCGCCTGGCTGGGACTCTGATCCCAGCCATGGCCTTCCTCTCCT
GCGTGAGACCAGAAAGCTGGGAGCCCTGCGTGGAGACTTGGCCCTAAACCACACAGAAGAGCTGGCATGAAACCC
AGAGCTTTCAGACTCCGGAGCCTCAGCCCTTCACCCCGATTCCATTGCTTCTTGCTAAATGCTGCCGTTTTATCA
CGGAGGTGGTTCCTAATATTACTTATCAATGCATGGAGCTGAATTTCTACAAAATCCCCGACAACCTCCCCTTCT
CAACCAAGAACCTGGACCTGAGCTTTAATCCCCTGAGGCATTTAGGCAGCTATAGCTTCTTCAGTTTCCCAGAAC
TGCAGGTGCTGGATTTATCCAGGTGTGAAATCCAGACAATTGAAGATGGGGCATATCAGAGCCTAAGCCACCTCT
CTACCTTAATATTGACAGGAAACCCCATCCAGAGTTTAGCCCTGGGAGCCTTTCTGGACTATCAAGTTTACAGA
AGCTGGTGGCTGTGGAGACAAATCTAGCATCTCTAGAGAACTTCCCCATTGGACATCTCAAAACTTTGAAAGAAC
TTAATGTGGCTCACAATCTTATCCAATCTTTCAAATTACCTGAGTATTTTTCTAATCTGACCAATCTAGAGCACT
TGGACCTTTCCAGCAACAAGATTCAAAGTATTTATTGCACAGACTTGCGGGTTCTACATCAAATGCCCCTACTCA
ATCTCTCTTTAGACCTGTCCCTGAACCCTATGAACTTTATCCAACCAGGTGCATTTAAAGAAATTAGGCTTCATA
AGCTGACTTTAAGAAATAATTTTGATAGTTTAAATGTAATGAAAACTTGTATTCAAGGTCTGGCTGGTTTAGAAG
TCCATCGTTTGGTTCTGGGAGAATTTAGAAATGAAGGAAACTTGGAAAAGTTTGACAAATCTGCTCTAGAGGGCC
TGTGCAATTTGACCATTGAAGAATTCCGATTAGCATACTTAGACTACTACCTCGATGATATTATTGACTTATTTA
ATTGTTTGACAAATGTTTCTTCATTTTCCCTGGTGAGTGTGACTATTGAAAGGGTAAAAGACTTTTCTTATAATT
TCGGATGGCAACATTTAGAATTAGTTAACTGTAAATTTGGACAGTTTCCCACATTGAAACTCAAATCTCTCAAAA
GGCTTACTTTCACTTCCAACAAAGGTGGGAATGCTTTTTCAGAAGTTGATCTACCAAGCCTTGAGTTTCTAGATC
TCAGTAGAAATGGCTTGAGTTTCAAAGGTTGCTGTTCTCAAAGTGATTTTGGGACAACCAGCCTAAAGTATTTAG
ATCTGAGCTTCAATGGTGTTATTACCATGAGTTCAAACTTCTTGGGCTTAGAACAACTAGAACATCTGGATTTCC
AGCATTCCAATTTGAAACAAATGAGTGAGTTTTCAGTATTCCTATCACTCAGAAACCTCATTTACCTTGACATTT
CTCATACTCACACCAGAGTTGCTTTCAATGGCATCTTCAATGGCTTGTCCAGTCTCGAAGTCTTGAAAATGGCTG
GCAATTCTTTCCAGGAAAACTTCCTTCCAGATATCTTCACAGAGCTGAGAAACTTGACCTTCCTGGACCTCTCTC
AGTGTCAACTGGAGCAGTTGTCTCCAACAGCATTTAACTCACTCTCCAGTCTTCAGGTACTAAATATGAGCCACA
ACAACTTCTTTTCATTGGATACGTTTCCTTATAAGTGTCTGAACTCCCTCCAGGTTCTTGATTACAGTCTCAATC
ACATAATGACTTCCAAAAAACAGGAACTACAGCATTTTCCAAGTAGTCTAGCTTTCTTAAATCTTACTCAGAATG
ACTTTGCTTGTACTTGTGAACACCAGAGTTTCCTGCAATGGATCAAGGACCAGAGGCAGCTCTTGGTGGAAGTTG
AACGAATGGAATGTGCAACACCTTCAGATAAGCAGGGCATGCCTGTGCTGAGTTTGAATATCACCTGTCAGATGA
ATAAGACCATCATTGGTGTGTCGGTCCTCAGTGTGCTTGTAGTATCTGTTGTAGCAGTTCTGGTCTATAAGTTCT
ATTTTCACCTGATGCTTCTTGCTGGCTGCATAAAGTATGGTAGAGGTGAAAACATCTATGATGCCTTTGTTATCT
ACTCAAGCCAGGATGAGGACTGGGTAAGGAATGAGCTAGTAAAGAATTTAGAAGAAGGGGTGCCTCCATTTCAGC
TCTGCCTTCACTACAGAGACTTTATTCCCGGTGTGGCCATTGCTGCCAACATCATCCATGAAGGTTTCCATAAAA
GCCGAAAGGTGATTGTTGTGGTGTCCCAGCACTTCATCCAGAGCCGCTGGTGTATCTTTGAATATGAGATTGCTC
AGACCTGGCAGTTTCTGAGCAGTCGTGCTGGTATCATCTTCATTGTCCTGCAGAAGGTGGAGAAGACCCTGCTCA
GGCAGCAGGTGGAGCTGTACCGCCTTCTCAGCAGGAACACTTACCTGGAGTGGGAGGACAGTGTCCTGGGGCGGC
ACATCTTCTGGAGACGACTCAGAAAAGCCCTGCTGGATGGTAAATCATGGAATCCAGAAGGAACAGTGGGTACAG
GATGCAATTGGCAGGAAGCAACATCTATCTGAAGAGGAAAAATAAAAACCTCCTGAGGCATTTCTTGCCCAGCTG
GGTCCAACACTTGTTCAGTTAATAAGTATTAAATGCTGCCACATGTCAGGCCTTATGCTAAGGGTGAGTAATTCC
ATGGTGCACTAGATATGCAGGGCTGCTAATCTCAAGGAGCTTCCAGTGCAGAGGGAATAAATGCTAGACTAAAAT
ACAGAGTCTTCCAGGTGGGCATTTCAACCAACTCAGTCAAGGAACCCATGACAAAGAAAGTCATTTCAACTCTTA
CCTCATCAAGTTGAATAAAGACAGAGAAAACAGAAAGAGACATTGTTCTTTTCCTGAGTCTTTTGAATGGAAATT
GTATTATGTTATAGCCATCATAAAACCATTTTGGTAGTTTTGACTGAACTGGGTGTTCACTTTTTCCTTTTTGAT
TGAATACAATTTAAATTCTACTTGATGACTGCAGTCGTCAAGGGGCTCCTGATGCAAGATGCCCCTTCCATTTTA
AGTCTGTCTCCTTACAGAGGTTAAAGTCTAGTGGCTAATTCCTAAGGAAACCTGATTAACACATGCTCACAACCA
TCCTGGTCATTCTCGAGCATGTTCTATTTTTAACTAATCACCCCTGATATATTTTATTTTTATATATCCAGTT
TTCATTTTTTTACGTCTTGCCTATAAGCTAATATCATAAATAAGGTTGTTTAAGACGTGCTTCAAATATCCATAT
TAACCACTATTTTTCAAGGAAGTATGGAAAAGTACACTCTGTCACTTTGTCACTCGATGTCATTCCAAAGTTATT
```

FIGURE 221B

```
GCCTACTAAGTAATGACTGTCATGAAAGCAGCATTGAAATAATTTGTTTAAAGGGGGCACTCTTTTAAACGGGAA
GAAAATTTCCGCTTCCTGGTCTTATCATGGACAATTTGGGCTAGAGGCAGGAAGGAAGTGGGATGACCTCAGGAG
GTCACCTTTTCTTGATTCCAGAAACATATGGGCTGATAAACCCGGGGTGACCTCATGAAATGAGTTGCAGCAGAA
GTTTATTTTTTCAGAACAAGTGATGTTTGATGGACCTCTGAATCTCTTTAGGGAGACACAGATGGCTGGGATCC
CTCCCCTGTACCCTTCTCACTGCCAGGAGAACTA
```

FIGURE 222

MELNFYKIPDNLPFSTKNLDLSFNPLRHLGSYSFFSFPELQVLDLSRCEIQTIEDGAYQSLSHLSTLILTGNPIQ
SLALGAFSGLSSLQKLVAVETNLASLENFPIGHLKTLKELNVAHNLIQSFKLPEYFSNLTNLEHLDLSSNKIQSI
YCTDLRVLHQMPLLNLSLDLSLNPMNFIQPGAFKEIRLHKLTLRNNFDSLNVMKTCIQGLAGLEVHRLVLGEFRN
EGNLEKFDKSALEGLCNLTIEEFRLAYLDYYLDDIIDLFNCLTNVSSFSLVSVTIERVKDFSYNFGWQHLELVNC
KFGQFPTLKLKSLKRLTFTSNKGGNAFSEVDLPSLEFLDLSRNGLSFKGCCSQSDFGTTSLKYLDLSFNGVITMS
SNFLGLEQLEHLDFQHSNLKQMSEFSVFLSLRNLIYLDISHTHTRVAFNGIFNGLSSLEVLKMAGNSFQENFLPD
IFTELRNLTFLDLSQCQLEQLSPTAFNSLSSLQVLNMSHNNFFSLDTFPYKCLNSLQVLDYSLNHIMTSKKQELQ
HFPSSLAFLNLTQNDFACTCEHQSFLQWIKDQRQLLVEVERMECATPSDKQGMPVLSLNITCQMNKTIIGVSVLS
VLVVSVVAVLVYKFYFHLMLLAGCIKYGRGENIYDAFVIYSSQDEDWVRNELVKNLEEGVPPFQLCLHYRDFIPG
VAIAANIIHEGFHKSRKVIVVVSQHFIQSRWCIFEYEIAQTWQFLSSRAGIIFIVLQKVEKTLLRQQVELYRLLS
RNTYLEWEDSVLGRHIFWRRLRKALLDGKSWNPEGTVGTGCNWQEATSI

FIGURE 223

ATGGCTTTAGAGATCCACATGTCAGACCCCATGTGCCTCATCGAGAACTTTAATGAGCAGCTGAAGGTTAATCAG
GAAGCTTTGGAGATCCTGTCTGCCATTACGCAACCTGTAGTTGTGGTAGCGATTGTGGGCCTCTATCGCACTGGC
AAATCCTACCTGATGAACAAGCTGGCTGGGAAGAACAAGGGCTTCTCTGTTGCATCTACGGTGCAGTCTCACACC
AAGGGAATTTGGATATGGTGTGTGCCTCATCCCAACTGGCCAAATCACACATTAGTTCTGCTTGACACCGAGGGC
CTGGGAGATGTAGAGAAGGCTGACAACAAGAATGATATCCAGATCTTTGCACTGGCACTCTTACTGAGCAGCACC
TTTGTGTACAATACTGTGAACAAAATTGATCAGGGTGCTATCGACCTACTGCACAATGTGACAGAACTGACAGAT
CTGCTCAAGGCAAGAAACTCACCCGACCTTGACAGGGTTGAAGATCCTGCTGACTCTGCGAGCTTCTTCCCAGAC
TTAGTGTGGACTCTGAGAGATTTCTGCTTAGGCCTGGAAATAGATGGGCAACTTGTCACACCAGATGAATACCTG
GAGAATTCCCTAAGGCCAAAGCAAGGTAGTGATCAAAGAGTTCAAAATTTCAATTTGCCTCGTCTGTGTATACAG
AAGTTCTTTCCAAAAAAGAAATGCTTTATCTTTGACTTACCTGCTCACCAAAAAAAGCTTGCCCAACTTGAAACA
CTGCCTGATGATGAGCTAGAGCCTGAATTTGTGCAACAAGTGACAGAATTCTGTTCCTACATCTTTAGCCATTCT
ATGACCAAGACTCTTCCAGGTGGCATCATGGTCAATGGATCTCGTCTAAAGAACCTGGTGCTGACCTATGTCAAT
GCCATCAGCAGTGGGGATCTGCCTTGCATAGAGAATGCAGTCCTGGCCTTGGCTCAGAGAGAGAACTCAGCTGCA
GTGCAAAAGGCCATTGCCCACTATGACCAGCAAATGGGCCAGAAAGTGCAGCTGCCCATGGAAACCCTCCAGGAG
CTGCTGGACCTGCACAGGACCAGTGAGAGGGAGGCCATTGAAGTCTTCATGAAAAACTCTTTCAAGGATGTAGAC
CAAAGTTTCCAGAAAGAATTGGAGACTCTACTAGATGCAAAACAGAATGACATTTGTAAACGGAACCTGGAAGCA
TCCTCGGATTATTGCTCGGCTTTACTTAAGGATATTTTTGGTCCTCTAGAAGAAGCAGTGAAGCAGGGAATTTAT
TCTAAGCCAGGAGGCCATAATCTCTTCATTCAGAAAACAGAAGAACTGAAGGCAAAGTACTATCGGGAGCCTCGG
AAAGGAATACAGGCTGAAGAAGTTCTGCAGAAATATTTAAAGTCCAAGGAGTCTGTGAGTCATGCAATATTACAG
ACTGACCAGGCTCTCACAGAGACGGAAAAAAAGAAGAAAGAGGCACAAGTGAAAGCAGAAGCTGAAAAGGCTGAA
GCGCAAAGGTTGGCGGCGATTCAAAGGCAGAACGAGCAAATGATGCAGGAGAGGGAGAGACTCCATCAGGAACAA
GTGAGACAAATGGAGATAGCCAAACAAAATTGGCTGGCAGAGCAACAGAAAATGCAGGAACAACAGATGCAGGAA
CAGGCTGCACAGCTCAGCACAACATTCCAAGCTCAAAATAGAAGCCTTCTCAGTGAGCTCCAGCACGCCCAGAGG
ACTGTTAATAACGATGATCCATGTGTTTTACTCTAA

FIGURE 224

MALEIHMSDPMCLIENFNEQLKVNQEALEILSAITQPVVVVAIVGLYRTGKSYLMNKLAGKNKGFSVASTVQSHT
KGIWIWCVPHPNWPNHTLVLLDTEGLGDVEKADNKNDIQIFALALLLSSTFVYNTVNKIDQGAIDLLHNVTELTD
LLKARNSPDLDRVEDPADSASFFPDLVWTLRDFCLGLEIDGQLVTPDEYLENSLRPKQGSDQRVQNFNLPRLCIQ
KFFPKKKCFIFDLPAHQKKLAQLETLPDDELEPEFVQQVTEFCSYIFSHSMTKTLPGGIMVNGSRLKNLVLTYVN
AISSGDLPCIENAVLALAQRENSAAVQKAIAHYDQQMGQKVQLPMETLQELLDLHRTSEREAIEVFMKNSFKDVD
QSFQKELETLLDAKQNDICKRNLEASSDYCSALLKDIFGPLEEAVKQGIYSKPGGHNLFIQKTEELKAKYYREPR
KGIQAEEVLQKYLKSKESVSHAILQTDQALTETEKKKEAQVKAEAEKAEAQRLAAIQRQNEQMMQERERLHQEQ
VRQMEIAKQNWLAEQQKMQEQQMQEQAAQLSTTFQAQNRSLLSELQHAQRTVNNDDPCVLL

FIGURE 225

```
GGCGGGGCTGGGCGCAGGCAGTCTCCCGCCGCCGCCGCTGCCGGACGCGCAGAGCGAGGGGCGGCTGGACCG
ACGGCTGCCGGGCCGAGCGCACAGAGTCGCGGCGCAGGGGGCGTCCCCGGCCGGGACGCGGGTCGCGTCGTTGTC
CTCCGCGAGCGTCCGGATTGCAGGCTGTCTGTCCCCAGACCCCAGAGCACGTCCGGCACCACCATGACTGGGCTG
TTGAAGAGGAAATTTGACCAGCTGGATGAGGACAACTCCTCGGTCTCCTCCTCCTCCTCTTCCTCTGGGTGCCAG
TCTCGCTCCTGCTCCCCAAGCTCTTCTGTCTCCCGTGCCTGGGACTCAGAGGAGGAAGGCCCTGGGATCAGATG
CCCCTGCCTGACCGTGACTTCTGCGGCCCCAGAAGTTTCACCCCCTGTCTATCCTGAAGCGAGCTCGCCGGGAG
CGCCCAGGCCGTGTAGCCTTTGATGGGATCACCGTCTTCTACTTCCCCCGCTGCCAGGGCTTCACCAGTGTGCCC
AGCCGTGGTGGCTGTACTCTGGGTATGGCCCTTCGCCACAGTGCTTGCCGTCGCTTCTCTTTGGCTGAGTTTGCG
CAGGAGCAAGCCCGTGCACGGCACGAGAAGCTCCGCCAGCGCTTGAAAGAGGAGAAGTTGGAGATGCTGCAGTGG
AAGCTTTCGGCAGCTGGGGTACCCCAGGCAGAGGCAGGGCTGCCACCTGTGGTGGATGCCATTGATGACGCCTCT
GTGGAGGAGGACTTGGCAGTCGCTGTGGCAGGTGGCCGGTTGGAAGAAGTGAGCTTCCTACAGCCCTACCCAGCC
CGGCGACGTCGAGCTCTGCTGAGGGCTTCAGGTGTGCGAAGGATCGATCGGGAGGAGAAGCGGGAGCTGCAGGCA
CTGCGCCAATCCCGGGAGGATTGTGGCTGTCACTGCGATAGGATCTGCGACCCTGAGACCTGCAGCTGCAGCCTG
GCAGGCATCAAGTGCCAGATGGACCACACAGCATTCCCCTGTGGCTGCTGCAGGGAGGGCTGTGAGAACCCCATG
GGCCGTGTGGAATTTAATCAGGCAAGAGTTCAGACCCATTTCATCCACACACTCACCCGCCTGCAGTTGGAACAG
GAGGCTGAGAGCTTTAGGGAGCTGGAGGCCCCTGCCCAGGGCAGCCCACCCAGCCCTGGTGAGGAGGCCCTGGTC
CCTACTTTCCCACTGGCCAAGCCCCCCATGAACAATGAGCTGGGAGACAACAGCTGCAGCAGCGACATGACTGAT
TCTTCCACAGCATCTTCATCAGCATCGGGCACTAGTGAGGCTCCTGACTGCCCCACCCACCCAGGCCTGCCTGGC
CCTGGCTTCCAGCCTGGCGTTGATGATGACAGCCTGGCACGCATCTTGAGTTTCAGTGACTCTGACTTCGGTGGG
GAGGAGGAGGAAGAGGAGGAAGGGAGTGTGGGGAACCTGGACAACCTCAGCTGCTTCCATCCAGCTGACATCTTT
GGTACTAGTGACCCTGGTGGCCTGGCCAGCTGGACCCACAGCTATTCTGGCTGTAGCTTCACATCAGGCATCCTG
GATGAGAATGCCAACCTGGATGCCAGCTGCTTCCTAAATGGTGGCCTTGAAGGGTCAAGGGAAGGCAGCCTTCCT
GGCACCTCAGTGCCACCCAGCATGGACGCTGGCCGGAGTAGCTCAGTGGATCTCAGCTTGTCTTCTTGTGACTCC
TTTGAGTTACTCCAGGCTCTGCCAGATTATAGTCTGGGGCCTCACTACACATCACAGAAGGTGTCTGACAGCCTG
GACAACATCGAGGCACCTCACTTCCCCCTGCCTGGCCTGTCTCCACCTGGGGATGCCAGCAGTTGCTTCCTGGAG
TCCCTCATGGGCTTCTCCGAGCCAGCCGCCGAAGCCCTAGATCCCTTTATTGACAGCCAGTTTGAGGACACTGTC
CCAGCATCTCTAATGGAGCCTGTGCCGGTGTGAGGACCAGGATGTCTTTTCCCAGCCCCAAGAGACCTGTTGCTG
CTTTCTTGTAATTATGGGGCTCCCCAGAGTCTGCGTAACAGTCTCCCACTGGCTGGCTCACCCACAGGTGCCATG
TGCACACTCCTGGTTTTCAAACAATTCTCTGGATTTATTTATTTGTTTTAACTTTTCTGTGCTGAAGAGAGGACT
AGGGGGAGGGGGCTTCCCCTTTCAGCTGCCCGGCCCCCCACACCCACAGCTTGCTCTTCTATCTCCACAACGTGA
GCCTGGAAGAGGAGAAAATGTGGCTCCTCTGGAGCTTGGCAGACCACTTTTCGGTCTTTGCGTGATGTTCCTTAG
CCCAAAGACGGTGAGACAGGGCTGAAATCAGGTGGCTTCTGCCACCCTGAGCCCTAGACCCATGGGTGGCTAAAT
CCACTGGACTGTGAAGACTATAATTTATTTCCATAATTTATTTGGAGATTGAGGAGGCTTTGGTTGCACTTCTTT
GGCTGGTGGGTAATGCCAGGGGTGGGGTGGGCACAGGCCCTCAAGAGCCCCTTTTGCCTTGTAGTCCTACACCTT
GCCCTGCCTGGGCTTTGGTGCAGACTAGGTGTGGATTTGAGCTCTGTGATCTATGTCTGCTGCCTGGCTCCTAGA
TGGCTCTGCGGGCAGGTGCTGGCCAAGGACATCATCTAGGCAGGGGGAGAGCCTGGGCTGAACAGCTGTGACCAA
AACTCCCTTCTGCCCCACCCTGCCCCCTCCACTTCCTGCCCTCTGTTCCATCTTCCCCCTTCCCAAAGGCCACAG
CCTTTATTCCAGGCCCAGGGATGTAGGAGGGGAAGGAGGAAACAGGAAGCCCAGAGAGGGCAAAGGGCCTACCT
CGGGGCGCGAACCATGCCCCAGACTATTATCTCAGGGCTTTCTGGGCACTGCACTTCAGCGTGGCCCACCTGCCC
ATGCCCTGAGGCCAGTTGGCGAGGGGTGGCTCCTGAGGGTTTTTATACCCTTTGTTTGCTAATGTTTAATTTTGC
ATCATAATTTCTACATTGTCCCTGAGTGTCAGAACTATAATTTATTCCATTTCTCTCTGTGTCTGTGCCAAGAAA
CGCAGGCTCTGGGCCTGCCCCTTGCCCAGGAGGCCTTGCCAGCCTGTGTGCTTGTGGGAACACCTTGTACCTGAG
CTTACAGGTACCAATAAAGAGGCTTTATTTTTAAAAAAAAAAAAAAAAAAAAAAA
```

FIGURE 226

MTGLLKRKFDQLDEDNSSVSSSSSSSGCQSRSCSPSSSVSRAWDSEEEGPWDQMPLPDRDFCGPRSFTPLSILKR
ARRERPGRVAFDGITVFYFPRCQGFTSVPSRGGCTLGMALRHSACRRFSLAEFAQEQARARHEKLRQRLKEEKLE
MLQWKLSAAGVPQAEAGLPPVVDAIDDASVEEDLAVAVAGGRLEEVSFLQPYPARRRRALLRASGVRRIDREEKR
ELQALRQSREDCGCHCDRICDPETCSCSLAGIKCQMDHTAFPCGCCREGCENPMGRVEFNQARVQTHFIHTLTRL
QLEQEAESFRELEAPAQGSPPSPGEEALVPTFPLAKPPMNNELGDNSCSSDMTDSSTASSSASGTSEAPDCPTHP
GLPGPGFQPGVDDDSLARILSFSDSDFGGEEEEEEEGSVGNLDNLSCFHPADIFGTSDPGGLASWTHSYSGCSFT
SGILDENANLDASCFLNGGLEGSREGSLPGTSVPPSMDAGRSSSVDLSLSSCDSFELLQALPDYSLGPHYTSQKV
SDSLDNIEAPHFPLPGLSPPGDASSCFLESLMGFSEPAAEALDPFIDSQFEDTVPASLMEPVPV

FIGURE 227

ACAGAAGTGCTAGAAGCCAGTGCTCGTGAACTAAGGAGAAAAAGAACAGACAAGGGAACAGCCTGGACATGGCAT
CAGAGATCCACATGACAGGCCCAATGTGCCTCATTGAGAACACTAATGGGCGACTGATGGCGAATCCAGAAGCTC
TGAAGATCCTTTCTGCCATTACACAGCCTATGGTGGTGGTGGCAATTGTGGGCCTCTACCGCACAGGCAAATCCT
ACCTGATGAACAAGCTGGCTGGAAAGAAAAAGGGCTTCTCTCTGGGCTCCACGGTGCAGTCTCACACTAAAGGAA
TCTGGATGTGGTGTGTGCCCCACCCCAAGAAGCCAGGCCACATCCTAGTTCTGCTGGACACCGAGGGTCTGGGAG
ATGTAGAGAAGGGTGACAACCAGAATGACTCCTGGATCTTCGCCCTGGCCGTCCTCCTGAGCAGCACCTTCGTGT
ACAATAGCATAGGAACCATCAACCAGCAGGCTATGGACCAACTGTACTATGTGACAGAGCTGACACATAGAATCC
GATCAAAATCCTCACCTGATGAGAATGAGAATGAGGTTGAGGATTCAGCTGACTTTGTGAGCTTCTTCCCAGACT
TTGTGTGGACACTGAGAGATTTCTCCCTGGACTTGGAAGCAGATGGACAACCCCTCACACCAGATGAGTACCTGA
CATACTCCCTGAAGCTGAAGAAAGGTACCAGTCAAAAAGATGAAACTTTTAACCTGCCCAGACTCTGTATCCGGA
AATTCTTCCCAAAGAAAAAATGCTTTGTCTTTGATCGGCCCGTTCACCGCAGGAAGCTTGCCCAGCTCGAGAAAC
TACAAGATGAAGAGCTGGACCCCGAATTTGTGCAACAAGTAGCAGACTTCTGTTCCTACATCTTTAGTAATTCCA
AAACTAAAACTCTTTCAGGAGGCATCCAGGTCAACGGGCCTCGTCTAGAGAGCCTGGTGCTGACCTACGTCAATG
CCATCAGCAGTGGGGATCTGCCGTGCATGGAGAACGCAGTCCTGGCCTTGGCCCAGATAGAGAACTCAGCTGCAG
TGCAAAAGGCTATTGCCCACTATGAACAGCAGATGGGCCAGAAGGTGCAGCTGCCCACAGAAAGCCTCCAGGAGC
TGCTGGACCTGCACAGGGACAGTGAGAGAGAGGCCATTGAAGTCTTCATCAGGAGTTCCTTCAAAGATGTGGACC
ATCTATTTCAAAAGGAGTTAGCGGCCCAGCTAGAAAAAAAGCGGGATGACTTTTGTAAACAGAATCAGGAAGCAT
CATCAGATCGTTGCTCAGGTTTACTTCAGGTCATTTTCAGTCCTCTAGAAGAAGAAGTGAAGGCGGGAATTTATT
CGAAACCAGGGGGCTATCGTCTCTTTGTTCAGAAGCTACAAGACCTGAAGAAAAAGTACTATGAGGAACCGAGGA
AGGGGATACAGGCTGAAGAGATTCTGCAGACATACTTGAAATCCAAGGAGTCTATGACTGATGCAATTCTCCAGA
CAGACCAGACTCTCACAGAAAAAGAAAAGGAGATTGAAGTGGAACGTGTGAAAGCTGAGTCTGCACAGGCTTCAG
CAAAAATGTTGCAGGAAATGCAAAGAAAGAATGAGCAGATGATGGAACAGAAGGAGAGGAGTTATCAGGAACACT
TGAAACAACTGACTGAGAAGATGGAGAACGACAGGGTCCAGTTGCTGAAAGAGCAAGAGAGGACCCTCGCTCTTA
AACTTCAGGAACAGGAGCAACTACTAAAAGAGGGATTTCAAAAAGAAAGCAGAATAATGAAAAATGAGATACAGG
ATCTCCAGACGAAAATGAGACGACGAAAGGCATGTACCATAAGCTAAAGACCAGAGCCTTCCTGTCACCCCTAAC
CAAGGCATAATTGAAACAATTTTAGAATTTGGAACAAGCGTCACTACATTTGATAATAATTAGATCTTGCATCAT
AACACCAAAAGTTTATAAAGGCATGTGGTACAATGATCAAAATCATGTTTTTTCTTAAAAAAAAAAAAAAGACTG
TAAATTGTGCAACAAAGATGCATTTACCTCTGTATCAACTCAGGAAATCTCATAAGCTGGTACCACTCAGGAGAA
GTTTATTCTTCCAGATGACCAGCAGTAGACAAATGGATACTGAGCAGAGTCTTAGGTAAAAGTCTTGGGAAATAT
TTGGGCATTGGTCTGGCCAAGTCTACAATGTCCCAATATCAAGGACAACCACCCTAGCTTCTTAGTGAAGACAAT
GTACAGTTATCCATTAGATCAAGACTACACGGTCTATGAGCAATAATGTGATTTCTGGACATTGCCCATGTATAA
TCCTCACTGATGATTTCAAGCTAAAGCAAACCACCTTATACAGAGATCTAGAATCTCTTTATGTTCTCCAGAGGA
AGGTGGAAGAAACCATGGGCAGGAGTAGGAATTGAGTGATAAACAATTGGGCTAATGAAGAAAACTTCTCTTATT
GTTCAGTTCATCCAGATTATAACTTCAATGGGACACTTTAGACCATTAGACAATTGACACTGGATTAAACAAATT
CACATAATGCCAAATACACAATGTATTTATAGCAACGTATAATTTGCAAAGATGGACTTTAAAAGATGCTGTGTA
ACTAAACTGAAATAATTCAATTACTTATTATTTAGAATGTTAAAGCTTATGATAGTCTTTTCTAATTCTTAACAC
TCATACTTGAAATCTTTCCGAGTTTCCCCAGAAGAGAATATGGGATTTTTTTTGACATTTTTGACCCATTTAATA
ATGCTCTTGTGTTTACCTAGTATATGTAGACTTTGTCTTATGTGTCAAAAGTCCTAGGAAAGTGGTTGATGTTTC
TTATAGCAATTAAAAATTATTTTTGAACTGA

FIGURE 228

```
MASEIHMTGPMCLIENTNGRLMANPEALKILSAITQPMVVVAIVGLYRTGKSYLMNKLAGKKKGFSLGSTVQSHT
KGIWMWCVPHPKKPGHILVLLDTEGLGDVEKGDNQNDSWIFALAVLLSSTFVYNSIGTINQQAMDQLYYVTELTH
RIRSKSSPDENENEVEDSADFVSFFPDFVWTLRDFSLDLEADGQPLTPDEYLTYSLKLKKGTSQKDETFNLPRLC
IRKFFPKKKCFVFDRPVHRRKLAQLEKLQDEELDPEFVQQVADFCSYIFSNSKTKTLSGGIQVNGPRLESLVLTY
VNAISSGDLPCMENAVLALAQIENSAAVQKAIAHYEQQMGQKVQLPTESLQELLDLHRDSEREAIEVFIRSSFKD
VDHLFQKELAAQLEKKRDDFCKQNQEASSDRCSGLLQVIFSPLEEEVKAGIYSKPGGYRLFVQKLQDLKKKYYEE
PRKGIQAEEILQTYLKSKESMTDAILQTDQTLTEKEKEIEVERVKAESAQASAKMLQEMQRKNEQMMEQKERSYQ
EHLKQLTEKMENDRVQLLKEQERTLALKLQEQEQLLKEGFQKESRIMKNEIQDLQTKMRRRKACTIS
```

FIGURE 229

```
TGCTCCCTTGGGCTCTAGAGAGGAGGCCCCTCTTAGCCCTCAGCCCCTCCTTCCTCTCTATCTTAAAGTAATTTG
ATCCTCAGGAATTTGTTCCGCCCTCATCTGGCCCGGCCAAATCCCGATTTGACAAATGCCAGGAAAAGGAAACTG
TTGAGAAACCGAAACTACTGGGGAAAGGGAGGGCTCACTGAGTAACCATCCCAGTAACCCGACCGCCGCTGGTCT
TCGCTGGACACCATGAGTCACACTGTCCAAACCTTCTTCTCTCCTGTCAACAGTGGCCAGCCCCCCAACTATGAG
ATGCTCAAGGAGGAGCACGAGGTGGCTGTGCTGGGGGGGCCCCACAACCCTGCTCCCCCGACGTCCACCGTGATC
CACATCCGCAGCGAGACCTCCGTGCCCGACCATGTCGTCTGGTCCCTGTTCAACACCCTCTTCATGAACCCCTGC
TGCCTGGGCTTCATAGCATTCGCCTACTCCGTGAAGTCTAGGGACAGGAAGATGGTTGGCGACGTGACCGGGGCC
CAGGCCTATGCCTCCACCGCCAAGTGCCTGAACATCTGGGCCCTGATTCTGGGCATCCTCATGACCATTCTGCTC
ATCGTCATCCCAGTGCTGATCTTCCAGGCCTATGGATAGATCAGGAGGCATCACTGAGGCCAGGAGCTCTGCCCA
TGACCTGTATCCCACGTACTCCAACTTCCATTCCTCGCCCTGCCCCGGAGCCGAGTCCTGTATCAGCCCTTTAT
CCTCACACGCTTTTCTACAATGGCATTCAATAAAGTGCACGTGTTTCTGGTGCTGCTG
```

FIGURE 230

MSHTVQTFFSPVNSGQPPNYEMLKEEHEVAVLGGPHNPAPPTSTVIHIRSETSVPDHVVWSLFNTLFMNPCCLGF
IAFAYSVKSRDRKMVGDVTGAQAYASTAKCLNIWALILGILMTILLIVIPVLIFQAYG

FIGURE 231

```
GCGCGTTCGGGAGCTTCGGCCCTGCGTAGGAGGCGGGTGCAGGTGTGGGTGCTGAGCCGCCCGCCGCCTGGAGGG
GGAGACAGCTTCAGGACACGCAGGCCGCAGCGAGGGCCCGGGCCCGGGGGATCCCAGGCCATGGATGCTCCCCAC
TCCAAAGCAGCCCTGGACAGCATTAACGAGCTGCCCGAGAACATCCTGCTGGAGCTGTTCACGCACGTGCCCGCC
CGCCAGCTGCTGCTGAACTGCCGCCTGGTCTGCAGCCTCTGGCGGGACCTCATCGACCTCATGACCCTCTGGAAA
CGCAAGTGCCTGCGAGAGGGCTTCATCACCAAGGACTGGGACCAGCCCGTGGCCGACTGGAAAATCTTCTACTTC
CTACGGAGCCTGCATAGGAACCTCCTGCGCAACCCGTGTGCTGAAGAGGATATGTTTGCATGGCAAATTGATTTC
AATGGTGGGGACCGCTGGAAGGTGGAGAGCCTCCCTGGAGCCCACGGGACAGATTTTCCTGACCCCAAAGTCAAG
AAGTATTTTGTCACATCCTACGAAATGTGCCTCAAGTCCCAGCTGGTGGACCTTGTAGCCGAGGGCTACTGGGAG
GAGCTACTAGACACATTCCGGCCGGACATCGTGGTTAAGGACTGGTTTGCTGCCAGAGCCGACTGTGGCTGCACC
TACCAACTCAAAGTGCAGCTGGCCTCGGCTGACTACTTCGTGTTGGCCTCCTTCGAGCCCCCACCTGTGACCATC
CAACAGTGGAACAATGCCACATGGACAGAGGTCTCCTACACCTTCTCAGACTACCCCCGGGGTGTCCGCTACATC
CTCTTCCAGCATGGGGGCAGGGACACCCAGTACTGGGCAGGCTGGTATGGGCCCCGAGTCACCAACAGCAGCATT
GTCGTCAGCCCCAAGATGACCAGGAACCAGGCCTCCTCCGAGGCTCAGCCTGGGCAGAAGCATGGACAGGAGGAG
GCTGCCCAATCGCCCTACCGAGCTGTTGTCCAGATTTTCTGACAGCTGTCCATCCTGTGTCTGGGTCAGCCAGAG
GTTCCTCCAGGCAGGAGCTGAGCATGGGGTGGGCAGTGAGGTCCCTGTACCAGCGACTCCTGCCCCGGTTCAACC
CTACCAGCTTGTGGTAACTTACTGTCACATAGCTCTGACGTTTTGTTGTAATAAATGTTTTCAGGCCGGGCACTG
TGGCTCACGCCTGTAATCCCAGCACTTTGGGAGACCGAGGCAGGTGGATCACGAGGTCAGGAGACAGAGACCATC
CTGGCCAACACGGTGAAACCCTGTCTCTACTAAAAATACAAAAAATTAGCCGGGCGTGGTGGCGGGCGCCTGTAG
TCCCAGCTACTCGGGAGGCTGATGCAGAAGAATGGCGTGAACCCGGAAGGCAGAGCTTGCAGTGAGCCGAGATCA
CGCCACTGCACTCCAGCCTGGGTGACAGAGCGAGACTCTGGCTCATAAAATAATAATAATAATAAATAAATAAAA
AATAAATGGTTTTCAGTAAAAAAAAAAAAAAAAAAA
```

FIGURE 232

MDAPHSKAALDSINELPENILLELFTHVPARQLLLNCRLVCSLWRDLIDLMTLWKRKCLREGFITKDWDQPVADW
KIFYFLRSLHRNLLRNPCAEEDMFAWQIDFNGGDRWKVESLPGAHGTDFPDPKVKKYFVTSYEMCLKSQLVDLVA
EGYWEELLDTFRPDIVVKDWFAARADCGCTYQLKVQLASADYFVLASFEPPPVTIQQWNNATWTEVSYTFSDYPR
GVRYILFQHGGRDTQYWAGWYGPRVTNSSIVVSPKMTRNQASSEAQPGQKHGQEEAAQSPYRAVVQIF

FIGURE 233

```
GCGCGCCGGCCTGAGAGCCCTGTGGACAACCTCGTCATTGTCAGGCACAGAGCGGTAGACCCTGCTTCTCTAAGT
GGGCAGCGGACAGCGGCACGCACATTTCACCTGTCCCGCAGACAACAGCACCATCTGCTTGGGAGAACCCTCTCC
CTTCTCTGAGAAAGAAAGATGTCGAATGGGTATTCCACAGACGAGAATTTCCGCTATCTCATCTCGTGCTTCAGG
GCCAGGGTGAAAATGTACATCCAGGTGGAGCCTGTGCTGGACTACCTGACCTTTCTGCCTGCAGAGGTGAAGGAG
CAGATTCAGAGGACAGTCGCCACCTCCGGGAACATGCAGGCAGTTGAACTGCTGCTGAGCACCTTGGAGAAGGGA
GTCTGGCACCTTGGTTGGACTCGGGAATTCGTGGAGGCCCTCCGGAGAACCGGCAGCCCTCTGGCCGCCCGCTAC
ATGAACCCTGAGCTCACGGACTTGCCCTCTCCATCGTTTGAGAACGCTCATGATGAATATCTCCAACTGCTGAAC
CTCCTTCAGCCCACTCTGGTGGACAAGCTTCTAGTTAGAGACGTCTTGGATAAGTGCATGGAGGAGGAACTGTTG
ACAATTGAAGACAGAAACCGGATTGCTGCTGCAGAAAACAATGGAAATGAATCAGGTGTAAGAGAGCTACTAAAA
AGGATTGTGCAGAAAGAAAACTGGTTCTCTGCATTTCTGAATGTTCTTCGTCAAACAGGAAACAATGAACTTGTC
CAAGAGTTAACAGGCTCTGATTGCTCAGAAAGCAATGCAGAGATTGAGAATTTATCACAAGTTGATGGTCCTCAA
GTGGAAGAGCAACTTCTTTCAACCACAGTTCAGCCAAATCTGGAGAAGGAGGTCTGGGGCATGGAGAATAACTCA
TCAGAATCATCTTTTGCAGATTCTTCTGTAGTTTCAGAATCAGACACAAGTTTGGCAGAAGGAAGTGTCAGCTGC
TTAGATGAAAGTCTTGGACATAACAGCAACATGGGCAGTGATTCAGGCACCATGGGAAGTGATTCAGATGAAGAG
AATGTGGCAGCAAGAGCATCCCCGGAGCCAGAACTCCAGCTCAGGCCTTACCAAATGGAAGTTGCCCAGCCAGCC
TTGGAAGGGAAGAATATCATCATCTGCCTCCCTACAGGGAGTGGAAAAACCAGAGTGGCTGTTTACATTGCCAAG
GATCACTTAGACAAGAAGAAAAAAGCATCTGAGCCTGGAAAAGTTATAGTTCTTGTCAATAAGGTACTGCTAGTT
GAACAGCTCTTCCGCAAGGAGTTCCAACCATTTTTGAAGAAATGGTATCGTGTTATTGGATTAAGTGGTGATACC
CAACTGAAAATATCATTTCCAGAAGTTGTCAAGTCCTGTGATATTATTATCAGTACAGCTCAAATCCTTGAAAAC
TCCCTCTTAAACTTGGAAAATGGAGAAGATGCTGGTGTTCAATTGTCAGACTTTTCCCTCATTATCATTGATGAA
TGTCATCACACCAACAAAGAAGCAGTGTATAATAACATCATGAGGCATTATTTGATGCAGAAGTTGAAAAACAAT
AGACTCAAGAAAGAAAACAAACCAGTGATTCCCCTTCCTCAGATACTGGGACTAACAGCTTCACCTGGTGTTGGA
GGGGCCACGAAGCAAGCCAAAGCTGAAGAACACATTTTAAAACTATGTGCCAATCTTGATGCATTTACTATTAAA
ACTGTTAAAGAAAACCTTGATCAACTGAAAAACCAAATACAGGAGCCATGCAAGAAGTTTGCCATTGCAGATGCA
ACCAGAGAAGATCCATTTAAAGAGAAACTTCTAGAAATAATGACAAGGATTCAAACTTATTGTCAAATGAGTCCA
ATGTCAGATTTTGGAACTCAACCCTATGAACAATGGGCCATTCAAATGGAAAAAAAAGCTGCAAAAAAAGGAAAT
CGCAAAGAACGTGTTTGTGCAGAACATTTGAGGAAGTACAATGAGGCCCTACAAATTAATGACACAATTCGAATG
ATAGATGCGTATACTCATCTTGAAACTTTCTATAATGAAGAGAAAGATAAGAAGTTTGCAGTCATAGAAGATGAT
AGTGATGAGGGTGGTGATGATGAGTATTGTGATGGTGATGAAGATGAGGATGATTTAAAGAAACCTTTGAAACTG
GATGAAACAGATAGATTTCTCATGACTTTATTTTTTGAAAACAATAAAATGTTGAAAAGGCTGGCTGAAAACCCA
GAATATGAAAATGAAAAGCTGACCAAATTAAGAAATACCATAATGGAGCAATATACTAGGACTGAGGAATCAGCA
CGAGGAATAATCTTTACAAAAACACGACAGAGTGCATATGCGCTTTCCCAGTGGATTACTGAAAATGAAAAATTT
GCTGAAGTAGGAGTCAAAGCCCACCATCTGATTGGAGCTGGACACAGCAGTGAGTTCAAACCCATGACACAGAAT
GAACAAAAAGAAGTCATTAGTAAATTTCGCACTGGAAAAATCAATCTGCTTATCGCTACCACAGTGGCAGAAGAA
GGTCTGGATATTAAAGAATGTAACATTGTTATCCGTTATGGTCTCGTCACCAATGAAATAGCCATGGTCCAGGCC
CGTGGTCGAGCCAGAGCTGATGAGAGCACCTACGTCCTGGTTGCTCACAGTGGTTCAGGAGTTATCGAACATGAG
ACAGTTAATGATTTCCGAGAGAAGATGATGTATAAAGCTATACATTGTGTTCAAAATATGAAACCAGAGGAGTAT
GCTCATAAGATTTTGGAATTACAGATGCAAAGTATAATGGAAAAGAAAATGAAAACCAAGAGAAATATTGCCAAG
CATTACAAGAATAACCCATCACTAATAACTTTCCTTTGCAAAAACTGCAGTGTGCTAGCCTGTTCTGGGGAAGAT
ATCCATGTAATTGAGAAAATGCATCACGTCAATATGACCCCAGAATTCAAGGAACTTTACATTGTAAGAGAAAAC
AAAGCACTGCAAAAGAAGTGTGCCGACTATCAAATAAATGGTGAAATCATCTGCAAATGTGGCCAGGCTTGGGGA
ACAATGATGGTGCACAAAGGCTTAGATTTGCCTTGTCTCAAAATAAGGAATTTTGTAGTGGTTTTCAAAAATAAT
TCAACAAAGAAACAATACAAAAAGTGGGTAGAATTACCTATCACATTTCCCAATCTTGACTATTCAGAATGCTGT
TTATTTAGTGATGAGGATTAGCACTTGATTGAAGATTCTTTTAAAATACTATCAGTTAAACATTTAATATGATTA
TGATTAATGTATTCATTATGCTACAGAACTGACATAAGAATCAATAAAATGATTGTTTTACTCTGAAAAAAAAAA
AAAAA
```

FIGURE 234

MSNGYSTDENFRYLISCFRARVKMYIQVEPVLDYLTFLPAEVKEQIQRTVATSGNMQAVELLLSTLEKGVWHLGW
TREFVEALRRTGSPLAARYMNPELTDLPSPSFENAHDEYLQLLNLLQPTLVDKLLVRDVLDKCMEEELLTIEDRN
RIAAAENNGNESGVRELLKRIVQKENWFSAFLNVLRQTGNNELVQELTGSDCSESNAEIENLSQVDGPQVEEQLL
STTVQPNLEKEVWGMENNSSESSFADSSVVSESDTSLAEGSVSCLDESLGHNSNMGSDSGTMGSDSDEENVAARA
SPEPELQLRPYQMEVAQPALEGKNIICLPTGSGKTRVAVYIAKDHLDKKKKASEPGKVIVLVNKVLLVEQLFRK
EFQPFLKKWYRVIGLSGDTQLKISFPEVVKSCDIIISTAQILENSLLNLENGEDAGVQLSDFSLIIIDECHHTNK
EAVYNNIMRHYLMQKLKNNRLKKENKPVIPLPQILGLTASPGVGGATKQAKAEEHILKLCANLDAFTIKTVKENL
DQLKNQIQEPCKKFAIADATREDPFKEKLLEIMTRIQTYCQMSPMSDFGTQPYEQWAIQMEKKAAKKGNRKERVC
AEHLRKYNEALQINDTIRMIDAYTHLETFYNEEKDKKFAVIEDDSDEGGDDEYCDGDEDEDDLKKPLKLDETDRF
LMTLFFENNKMLKRLAENPEYENEKLTKLRNTIMEQYTRTEESARGIIFTKTRQSAYALSQWITENEKFAEVGVK
AHHLIGAGHSSEFKPMTQNEQKEVISKFRTGKINLLIATTVAEEGLDIKECNIVIRYGLVTNEIAMVQARGRARA
DESTYVLVAHSGSGVIEHETVNDFREKMMYKAIHCVQNMKPEEYAHKILELQMQSIMEKKMKTKRNIAKHYKNNP
SLITFLCKNCSVLACSGEDIHVIEKMHHVNMTPEFKELYIVRENKALQKKCADYQINGEIICKCGQAWGTMMVHK
GLDLPCLKIRNFVVVFKNNSTKKQYKKWVELPITFPNLDYSECCLFSDED

FIGURE 235

```
AAAATTTGAAGACAAGATGGGCACCTACTCTACAATTCTGATAAAAACAGAGGTCATCGAATGTGGGAACTACTG
TGGAGTACGCATCATTCACTCTTTGATTGCAGAGTTCTCACTGGAAGAATTGAAGAAAAGCTATCACCTGAATAA
AAGTCAAATTATGTTGGATATGCTAACTGAGAATTTGTTCTTCGATACTGGTATGGGAAAAAGTAAATTTTTGCA
AGATATGCACACACTCCTACTCACAAGACACCGCGATGAACATGAAGGTGAAACAGGAAATTGGTTTTCCCCATT
TATTGAAGCATTACATAAAGATGAAGGAAATGAAGCAGTTGAAGCTGTATTGCTTGAAAGTATCCATCGGTTCAA
CCCAAATGCATTCATTTGCCAAGCGTTGGCAAGACATTTCTACATTAAAAAGAAGGACTTTGGCAATGCTCTAAA
CTGGGCAAAACAAGCAAAAATCATAGAACCTGACAATTCTTATATCTCAGATACACTGGGTCAAGTCTACAAAAG
TAAAATAAGATGGTGGATAGAGGAAAACGGAGGAAACGGGAACATTTCAGTTGATGATCTAATTGCTCTTTTGGA
TTTAGCAGAACATGCCTCAAGTGCATTCAAAGAATCTCAACAGCAAAGTGAAGATAGAGAGTATGAAGTGAAGGA
AAGATTGTATCCGAAGTCAAAAAGGCGGTATGATACTTACAATATAGCTGGTTATCAAGGAGAGATAGAAGTTGG
GCTTTACACAATCCAAATTCTCCAGCTCATTCCTTTTTTTGATAATAAAAATGAGCTATCTAAAAGATATATGGT
CAATTTTGTATCAGGAAGTAGTGATATTCCAGGGGATCCAAACAATGAATATAAATTAGCCCTCAAAAACTATAT
TCCTTATTTAACTAAATTGAAATTTTCTTTGAAAAAGTCCTTTGATTTTTTGATGAATACTTTGTCCTGCTAAA
ACCCAGGAACAATATTAAGCAAAATGAAGAGGCCAAAACTCGGAGAAAGGTGGCTGGATATTTTAAGAAATATGT
AGATATATTTTGTCTCTTAGAAGAATCACAAAACAACACAGGTCTTGGATCAAAGTTCAGTGAGCCACTTCAAGT
AGAGAGATGCAGGAGAAACCTAGTAGCTTTAAAAGCAGACAAGTTTTCTGGGCTCTTGGAATATCTTATCAAAAG
TCAAGAGGATGCTATAAGCACTATGAAATGTATAGTGAACGAATATACTTTTCTCTTAGAACAATGCACTGTCAA
AATCCAGTCAAAAGAAAAGCTAAATTTCATCTTGGCCAACATTATTCTCTCCTGTATCCAACCTACCTCCAGATT
AGTAAAGCCAGTTGAAAAACTAAAAGATCAGCTTCGAGAAGTCTTGCAACCAATAGGACTGACTTATCAGTTTTC
AGAACCGTATTTTCTAGCTTCCCTCTTATTCTGGCCAGAAAATCAACAACTAGATCAACATTCTGAACAAATGAA
AGAGTATGCTCAAGCACTAAAAAATTCTTTCAAGGGGCAATATAAACATATGCATCGTACAAAGCAACCAATTGC
ATATTTCTTTCTTGGAAAAGGTAAAAGACTGGAAAGACTTGTTCACAAAGGAAAAATTGACCAGTGCTTTAAGAA
GACACCAGATATTAATTCCTTGTGGCAGAGTGGAGATGTGTGGAAGGAGGAAAAAGTCCAAGAACTTTTGCTTCG
TTTACAAGGTCGAGCTGAAAACAATTGTTTATATATAGAATATGGAATCAATGAAAAAATCACAATACCCATCAC
TCCCGCTTTTTTAGGTCAACTTAGAAGTGGCAGAAGCATAGAGAAGGTGTCTTTTACCTGGGATTTCCCATTGG
AGGCCCACTTGCTTATGACATTGAAATTGTTTAAGAGCCTGATATTCTTCCTCCAAGAATTTGATCTCAGTACCC
ATTTAATTTTTTGGACTCAAGATCTATGCTTTAAACCGGCAAGGTTATAGATACAGCCTCTAGCTCTTCAGATC
TGTACATGCAGTATTTAATTTCCTCTTAAACATGTTATGAGTTCTACAAGGACAATAGTGAAAAAGGAAGGAGTG
AGATATATGAAAAGTAGCAAATATGTTCCTTGGTTTGGTTAACATCATTGATGACAAAATAATAAGGAGCTATGA
CTGGAGTCAGGAGAAGTTAGTGTAATAAGCTGGCTACACAGAACCCCACTACTTACCAGGCATGGATTGAAGAAG
ATTGTCTACTCAAATGGCATTTAGACATTAGAATGTCTGGGAAAATATTTCTCAAAGACAGCAAAAACCTCTCAA
ACTGAGGAGCAACATTTATTCTTACTAAGCAGATCATCAATGTATCATGTGCTTGGCACTCAAGGATCTTCCAAA
ACAGAGGACCAACCAGTCTTCTGAAGGTCATGCCCACAGAAGTCATCGGACCTTACCAAAGTAGGTTGGAGAATT
AGATTGCCTTTTCATGCAGTGAGATTCAGTTAAGCAAAAATGAAATTTGTCTCTATAGCTAATTAGCTTATCAAC
TCCCCTCCAAACAAACAATTAAAAAAAAAAACATACAGACACTCAAATTCCACAAGCTAATGAACAAAAGGGACTC
TTGTGAGAAGACTAATGAGTCCCTCATCCAGAAGATGCCAATGTACTGGCAGATTAACATACAACCTATGTTTTG
AACAAAAACAACCAGCGATACGTAATCAAAATGTAATTTTCCCCTAATAAAATTATGGATATGGGCAGTCATCAA
TGGCTGCCAAAACCATTAAGTGGAAAGCTGATTAAAAAACAAAAATTTCTAATGGATTTATCAAACTGTCCCAAA
TCCTGATAAATATTAACATCACAGAGGAAGACCAGACATTATGGGCCTGGAAGTACTATAGGAGTGCACACATCA
CCCGTGACATGGTCTTGCCAAATAATTAAACCTGAATTTGATCAGGTCTCTGGATCTTATTTGCAATTCAAAAGA
AATTTTAAAAAAATCCTACTAACACCACCACAAATATGCAATCAGCAATATCCAGAAAGGGGAAATTCACAGGAC
AAAAACCTGGTTTTCTTTTTTGGTTTCTTCAACCAAAAAAGAAAGAAATTGCAAAGGACCAAAAAAATGTTGGGG
AATCTATACATTATAAGGGACTTAACAACTAAAGGGCAACATATAGACTTTAGATCCTAATTTGAGCAAAATCTA
AAATCAATTATTAGGCAATCAGAAAAATTTGAACACAGACTAGATATTTGAGGATATTAAGGTACTATATTATTG
AAGATTCCATGGTTATGTTTTTAAAGAGTTCATGCCTTTTAGAGATACATACTAAAGTATTTGTAAATAAATGA
CATGATCTAGAAAAAAAAAAAAAAAAAAA
```

FIGURE 236

MGTYSTILIKTEVIECGNYCGVRIIHSLIAEFSLEELKKSYHLNKSQIMLDMLTENLFFDTGMGKSKFLQDMHTL
LLTRHRDEHEGETGNWFSPFIEALHKDEGNEAVEAVLLESIHRFNPNAFICQALARHFYIKKKDFGNALNWAKQA
KIIEPDNSYISDTLGQVYKSKIRWWIEENGGNGNISVDDLIALLDLAEHASSAFKESQQQSEDREYEVKERLYPK
SKRRYDTYNIAGYQGEIEVGLYTIQILQLIPFFDNKNELSKRYMVNFVSGSSDIPGDPNNEYKLALKNYIPYLTK
LKFSLKKSFDFFDEYFVLLKPRNNIKQNEEAKTRRKVAGYFKKYVDIFCLLEESQNNTGLGSKFSEPLQVERCRR
NLVALKADKFSGLLEYLIKSQEDAISTMKCIVNEYTFLLEQCTVKIQSKEKLNFILANIILSCIQPTSRLVKPVE
KLKDQLREVLQPIGLTYQFSEPYFLASLLFWPENQQLDQHSEQMKEYAQALKNSFKGQYKHMHRTKQPIAYFFLG
KGKRLERLVHKGKIDQCFKKTPDINSLWQSGDVWKEEKVQELLLRLQGRAENNCLYIEYGINEKITIPITPAFLG
QLRSGRSIEKVSFYLGFPIGGPLAYDIEIV

FIGURE 237A

```
GGAGAGTCTGCATCAGATTCGGCCTCAGATTCTACAGCATCTGACTACATTCCCAGTAGGTTGTGACAGTTGGAA
GTGTCATGTACAACATGCGGCGATTAAGTCTTTCACCCACCTTTTCAATGGGATTTCATCTGTTAGTTACTGTGA
GTCTCTTATTTTCCCATGTGGACCATGTAATTGCTGAGACAGAAATGGAAGGAGAAGGAAATGAAACTGGTGAAT
GTACTGGATCATATTACTGTAAGAAAGGGGTGATTTTGCCCATTTGGGAACCCCAAGACCCTTCTTTTGGGGACA
AAATTGCTAGAGCTACTGTGTATTTTGTGGCCATGGTCTACATGTTTCTTGGAGTCTCTATCATAGCTGATCGGT
TCATGTCCTCTATAGAAGTCATCACATCTCAAAAAAAAGAAATAACCATAAAGAAACCCAATGGAGAGACCACCA
AGACAACTGTGAGGATCTGGAATGAAACAGTTTCTAACCTGACCTTGATGGCCCTGGGATCTTCTGCTCCTGAGA
TTCTCCTTTCAGTAATTGAAGTGTGTGGCCATAACTTCACTGCAGGAGACCTCGGTCCTAGCACCATCGTGGGAA
GTGCTGCATTCAATATGTTCATCATTATTGCACTCTGTGTTTATGTGGTGCCTGACGGAGAGACAAGGAAGATTA
AGCATTTGCGTGTCTTCTTTGTGACAGCAGCCTGGAGCATCTTTGCCTACACCTGGCTTTACATTATTTTGTCTG
TCATATCTCCTGGTGTTGTGGAGGTCTGGGAAGGTTTGCTTACTTTCTTCTTCTTTCCCATCTGTGTTGTGTTCG
CTTGGGTAGCGGATAGGAGACTTCTGTTTTACAAGTATGTCTACAAGAGGTATCGAGCTGGCAAGCAGAGGGGGA
TGATTATTGAACATGAAGGAGACAGGCCATCTTCTAAGACTGAAATTGAAATGGACGGGAAAGTGGTCAATTCTC
ATGTTGAAAATTTCTTAGATGGTGCTCTGGTTCTGGAGGTGGATGAGAGGGACCAAGATGATGAAGAAGCTAGGC
GAGAAATGGCTAGGATTCTGAAGGAACTTAAGCAGAAGCATCCAGATAAAGAAATAGAGCAATTAATAGAATTAG
CTAACTACCAAGTCCTAAGTCAGCAGCAAAAAAGTAGAGCATTTTATCGCATTCAAGCTACTCGCCTCATGACTG
GAGCTGGCAACATTTTAAAGAGGCATGCAGCTGACCAAGCAAGGAAGGCTGTCAGCATGCACGAGGTCAACACTG
AAGTGACTGAAAATGACCCTGTTAGTAAGATCTTCTTTGAACAAGGGACATATCAGTGTCTGGAGAACTGTGGTA
CTGTGGCCCTTACCATTATCCGCAGAGGTGGTGATTTGACTAACACTGTGTTTGTTGACTTCAGACCAGAGGATG
GCACAGCAAATGCTGGGTCTGATTATGAATTTACTGAAGGAACTGTGGTGTTTAAGCCTGGTGATACCCAGAAGG
AAATCAGAGTGGGTATCATAGATGATGATATCTTTGAGGAGGATGAAAATTTCCTTGTGCATCTCAGCAATGTCA
AGTATCTTCTGAAGCTTCAGAAGATGGCATACTGGAAGCCAATCATGTTTCTACACTTGCTTGCCTCGGATCTC
CCTCCACTGCCACTGTAACTATTTTTGATGATGACCACGCAGGCATTTTTACTTTTGAGGAACCTGTGACTCATG
TGAGTGAGAGCATTGGCATCATGGAGGTGAAAGTATTGAGAACATCTGGAGCTCGAGGAAATGTTATCGTTCCAT
ATAAAACCATCGAAGGGACTGCCAGAGGTGGAGGGGAGGATTTTGAGGACACTTGTGGAGAGCTCGAATTCCAGA
ATGATGAAATTGTCAAAACAATATCAGTCAAGGTAATTGATGATGAGGAGTATGAGAAAAACAAGACCTTCTTCC
TTGAGATTGGAGAGCCCCGCCTGGTGGAGATGAGTGAGAAGAAAGCCCTGTTATTGAATGAGCTTGGTGGCTTCA
CAATAACAGGAAAATACCTGTTTGGCCAACCTGTCTTCAGGAAGGTTCATGCTAGAGAACATCCGATTCTCTCTA
CTGTAATCACCATTGCAGACGAATATGATGACAAGCAGCCACTGACCAGCAAAGAGGAAGAGGAGAGGCGCATTG
CAGAAATGGGGCGCCCCATCCTGGGAGAGCACACCAAGTTGGAAGTGATCATTGAAGAATCCTATGAATTCAAGA
GTACTGTGGACAAACTCATTAAGAAGACAAACCTGGCCCTTGTGGTTGGGACTAACAGCTGGAGAGAACAGTTCA
TTGAAGCTATCACTGTCAGTGCTGGGGAAGATGATGACGACGATGAATGTGGGGAAGAGAAGCTGCCCTCCTGTT
TCGATTACGTGATGCACTTTCTGACTGTGTTCTGGAAGGTCCTGTTTGCCTTCGTCCCCCCTACTGAATACTGGA
ATGGCTGGGCGTGTTTCATTGTCTCCATCCTCATGATTGGCCTACTGACAGCTTTCATTGGAGACCTGGCTTCCC
ACTTTGGCTGCACCATTGGCCTGAAAGATTCTGTGACTGCAGTCGTGTTCGTCGCACTTGGAACATCAGTGCCAG
ACACATTTGCCAGCAAAGTGGCAGCCACCCAGGACCAGTATGCAGACGCCTCCATAGGTAACGTCACGGGCAGCA
ACGCGGTGAATGTCTTCCTGGGAATCGGTGTGGCCTGGTCCATCGCTGCCATCTACCACGCAGCCAATGGGGAAC
AGTTCAAAGTGTCCCCTGGCACACTAGCTTTCTCTGTCACTCTCTTCACCATTTTGCTTTCATCAATGTGGGGG
TGCTGCTGTATCGGCGGAGGCCAGAAATCGGAGGTGAGCTGGGTGGGCCCGGACTGCCAAGCTCCTCACATCCT
GCCTCTTTGTGCTCCTATGGCTCTTGTACATTTTCTTCCTCCCTGGAGGCCTACTGCCACATAAAAGGCTTCT
AAAGGAACTATCAGATATAGTAAATTTATATATATACATATATATACATAAAAATTATGTATAATGGACAGAGGA
AACTGACATTTGTCATGTTCACTTACCTGCTGATGGAATCCAGCTTCAAGAGCATACTCTGTACTAGGGCCGAAG
TAAAAAACCATCACCTCCCATTCCCAGGGGCATCATCATGTTCAACAAGGCATGGAGGCAGGGCCATCTTTGCAG
CTCAGTCTAGAAGGGCTGCACTCTCTCCAGGTTGATAAATCCTTAAGGCTTTGATTTGTTTTGTTTTGGTTTTG
TTTCAGTGGAGCTGGGGAGGTAGTTAATGTTTGGCTTTATTTTGTTATTTTGTTTGTTTTGTTTTTTGGGA
GAGTCAGGGTTGTTGCTTTTCTTTGTGGAAAGTGAAACCATCCAAATGTAAATGGGTTTGGTAAAAATTTAAAT
CATTAGTATTCCCCCTCACCTCCCCCAATCACTTTAAAACTTATTTTGGATTAAGAAAAAATCTGGGCATGGAAG
AAGAAAGAAGCATGTCTTCATCGTATTACCAAAGTTCATGCTTATCTCCGGAATGTGAGTGGAGGTGAAGCTGCC
```

FIGURE 237B

```
TCCAAGAAGAAGCATAAAAGTGGAATGGAGCCAGGAAATCCGATGGTTCTAGAAATAGTCTGATATTTAAACATG
TGATACCTGGCAGTCTCGTTTAACAGGTACAAGGAAAACGTGCCTAGATTCCCAGGAACATGCAAAATCCTTTCT
TTCTTATCTCTTTAGCTCTGGACTGTGATTGGCAAGGTCCTTCTTCCAGCATTCAGCCCAGCTAAGCCCCCAGGT
GCCCCATCCCAACCCTGTTCCTCCTGTCCACCTGCCATCCCTATGCAAACAGTAAGAATAACCCCATTCAAAAA
GCACATCATCGTTTTCCATTTGCATTAACATGTGTCTCAGTCCCATGTTGCCGTTGCTTGGGATTGTCTGTCAGT
TTTATTTTCAAAGGCATCCATGGCTTGCACAATCCTGTTCCAGTCATGACTGAACATTTGCTCCTTCTTCATGTG
CCGTTCGGAAATGTTGTTGTGATACCTGTTACACAGTGCATGGTGAAAAACAAATAAAACAAAACAAAGAGTATC
TGTATATAGTAGAGTATAGTACATACTGTTCTCCCATTTGGCAATGTTGATTGGACATTGAAGACATAAGTGAGT
TTTCTTTTCACCTGAGTTGTTACTTTTGTGCTGTTATTGAGTTTGATTAATTACTAGGGATAAAAGGAGAAAATG
GATTATTGTTCACGGTTCTGCACATTCATTTCTAAGAAGCAATAACTGTCATGTGGGGAGAAGTTAAAGCTATTG
AGAGGATAGCAGGCAAACTACAAAGATCTTCATGGAAAATTAGCCATGTGGAACACATCAGAGGCCTCTAAAAAT
CACCCATTAATTCAGGAAGGCCAAGGAGAAAGGCCTTATAGAGACGTTGATATGTTGGATGTGCCTAGGCTTTCA
GAGCCACCCTTTCCACAACACCCCTCCCTGCAAAGTATTTATTTCACATCTGCACTGTCTGGCACAGATGGTAGA
TAGTGCTGGTTTGTTCATTTTATTTTTTACTTAAAAGGCTATTTTGAGCCCTGTTTCTTTCACTGTCCAGTCTA
GTCCTCTTTGATTATATCAGTAGTTGCTGAGTAAGAAAGAAGCCAGGGTGACCAACGGGCCTTTAAAAGTGTTGT
CTCCTCTACTTATGCTGAAAGAGAAGGCAATTAAATAAGACTAGTACCTCCCAGGAGGATTGGACTGGGATATTT
TTAACCCTTTAAAAAGAATAGCTGTTTCTATGTTAAAATACCAAAGAACATGGATAAACCCAACATTCCAAAGTA
GTGAGTCCACTAATGAGAAAAATAATAGAATGACTTTGGTCACCTCTCGGAGACTTCTGTGTCTATAAGGAATCC
CAGGCTGGAGACATTCCTAGCCCTCTGTATTGATTCAAAAATACTTAATAAATTAAAGCTGTTGAGACTTATTTT
TTCTTCTGTCACTCAGTAACCATGATCCTTCCTCATTTAATAAACATTTGGTGACTGAATGAGTAATTAAATGCT
GGTTACCCACTTAATGTGCCAGGTAGTATGATACTTTCTGGGGACTAAGCCATGAACAAAACAGTCTAGATCCTG
CCCTCAGAAGGGTTACAGTTTATGTGATTACTATTTTCATGAGTAAAAGTGAAGAAAGCCATATGGAAAGATTTT
TATCTTGCAAGAAAAAACAATTATGAAACTCTTTTAACATAAACACACTGAAACTGTATCAAAGCAATTGTCCAA
ATTGTATTTATACCCAAGAATTTCTTTAACTAAGAGAGCATAAGGCATATGTTTGGAAAACCACCCTCTTTATCT
TTGACCGGCTTGCAGATAAATATATCTCTCCATTTTAAACCAAGAAGGGCAATCATGTTGGTGATCCAGATCACT
GAGAAAGCCCAGTGTATCCCATCTTTTATCTTTGTTGGCAATGGAACTTTTCTATGCCCACACTTTACAATTCT
TTGTCATTCTAACCCATCCTTCCCATCCTTATTTTTTTTTTTGAGAATTGCTAAATGGAAAGCTAGCCTAGAA
GCACCAAGTAAATATATTCAAGGAATATAAGTTGTTTAAACATTAGAAAAATTTTGCACTCATTTTTAGCTGT
ATTAGGAATGTCAATAATCCTGTAGCAAATTTTCACAGAGAACTTTAAGAAATTCTTGCATTGGTCGATTTCAAT
TTGAAAGCTTTTTGGTTTGTTTGCTTTTAAATTTTCATGTTCTAGGAAACTATGATTCTGGTTGTTCAGGATTG
TTATTATTATAGTTGTGTAAAATTATTTTATTTTGTGTGTATTGTGCACAGCTTGGGGGGGGGCGGGAAATGCAC
TAATTGTGCTCTTCCTTATAAATGGTACATATTACTGACACAGACAAATAAAGTTTCTAATTGTTTCTGATTTAA
TCACTAGTGATACAGCATATTCTGTATGAAATGTTTTCTCCTTTCTCATTGTCATCTACTTCATTTTTGTTTTC
ATGTTTTGAAGAAATAAAAACCAAAATGGTATTATTGTGCAACTGGTATCATCATCCAAAGAAAAAAACAGACAC
CAAGTATTCAAACTCTTGCAAACGTCAACCCTTCGGTCATGCAATGTTCTCTTTTAATGTCCCAGGAGAACACA
GTGTCAGAATATTTGTCTGTCCTACAGTGCTGAGATATATGTTGGACA
```

FIGURE 238

MYNMRRLSLSPTFSMGFHLLVTVSLLFSHVDHVIAETEMEGEGNETGECTGSYYCKKGVILPIWEPQDPSFGDKI
ARATVYFVAMVYMFLGVSIIADRFMSSIEVITSQKKEITIKKPNGETTKTTVRIWNETVSNLTLMALGSSAPEIL
LSVIEVCGHNFTAGDLGPSTIVGSAAFNMFIIIALCVYVVPDGETRKIKHLRVFFVTAAWSIFAYTWLYIILSVI
SPGVVEVWEGLLTFFFFPICVVFAWVADRRLLFYKYVYKRYRAGKQRGMIIEHEGDRPSSKTEIEMDGKVVNSHV
ENFLDGALVLEVDERDQDDEEARREMARILKELKQKHPDKEIEQLIELANYQVLSQQQKSRAFYRIQATRLMTGA
GNILKRHAADQARKAVSMHEVNTEVTENDPVSKIFFEQGTYQCLENCGTVALTIIRRGGDLTNTVFVDFRPEDGT
ANAGSDYEFTEGTVVFKPGDTQKEIRVGIIDDDIFEEDENFLVHLSNVKVSSEASEDGILEANHVSTLACLGSPS
TATVTIFDDDHAGIFTFEEPVTHVSESIGIMEVKVLRTSGARGNVIVPYKTIEGTARGGGEDFEDTCGELEFQND
EIVKTISVKVIDDEEYEKNKTFFLEIGEPRLVEMSEKKALLLNELGGFTITGKYLFGQPVFRKVHAREHPILSTV
ITIADEYDDKQPLTSKEEEERRIAEMGRPILGEHTKLEVIIEESYEFKSTVDKLIKKTNLALVVGTNSWREQFIE
AITVSAGEDDDDDECGEEKLPSCFDYVMHFLTVFWKVLFAFVPPTEYWNGWACFIVSILMIGLLTAFIGDLASHF
GCTIGLKDSVTAVVFVALGTSVPDTFASKVAATQDQYADASIGNVTGSNAVNVFLGIGVAWSIAAIYHAANGEQF
KVSPGTLAFSVTLFTIFAFINVGVLLYRRRPEIGGELGGPRTAKLLTSCLFVLLWLLYIFFSSLEAYCHIKGF

FIGURE 239

```
TTGACGTCATCTGGAGGAGATTTGCTTTCTTTTTCTCCAAAAGGGGAGGAAATTGAAACTGAGTGGCCCACGATG
GGAAGAGGGGAAAGCCCAGGGGTACAGGAGGCCTCTGGGTGAAGGCAGAGGCTAACATGGGGTTCGGAGCGACCT
TGGCCGTTGGCTGACCATCTTTGTGCTGTCTGTCGTCACTATCATCATCTGCTTCACCTGCTCCTGCTGCTGCCT
TTACAAGACGTGCCGCCGACCACGTCCGGTTGTCACCACCACCACATCCACCACTGTGGTGCATGCCCCTTATCC
TCAGCCTCCAAGTGTGCCGCCCAGCTAACCTGGACCAAGCTACCAGGCTAGCACACCATGCCGCCTCAGCCAGGA
TGCCAGCAGCAACCTACCCAATGCAGTACCCACCACCTTAACCAGCCCAGCCCATGGGCCCACCGGCTTACAACG
AGACCCTGGCTTGAGGAGCAGCCGCGCCCTACCCCGCCAGCCAGCCTCCTTACAACCCGGCCTACATGGATGCCC
CGAAGCGGCCCTCTGAGCATTCCCTGGCCTCTCTGGCTGCCACTTGGTTATGTTGTGTGTGCGTGAGTGGTGT
GCAGGCGCGGTTCCTTACGCCCCATGTGTGCTGTGTGTCCTGCCTGTATATGTGGCTTCCTCTGATGCTGACA
AGGTGGGGAACAATCCTTGCCAGAGTGGGCTGGGACCAGACTTTGTTCTCTTCCTCACCTGAAATTATGCTTCCT
AAAATCTCAAGCCAAACTCAAAGAATGGGGTGGTGGGGGGCACCCTGTGAGGTGGCCCTGAGAAGGTGGGGGCCT
CTCCAGGGCACATCTGGAGTTCTTCTCCAGCTTACCCTAGGGTGACCAAGTAGGGCCTGTCACACCAGGGTGGCG
CAGCTTTCTGTGTGATGCAGATGTGTCCTGGTTTCGGCAGCGTAGCCAGCTGCTGCTTGAGGCCATGGCTCGTCC
CCGGAGTTGGGGGTACCCGTTGCAGAGCCAGGGACATGATGCAGGCGAAGCTTGGGATCTGGCCAAGTTGGACTT
TGATCCTTTGGGCAGATGTCCCATTGCTCCCTGGAGCCTGTCATGCCTGTTGGGGATCAGGCAGCCTCCTGATGC
CAGAACACCTCAGGCAGAGCCCTACTCAGCTGTACCTGTCTGCCTGGACTGTCCCCTGTCCCCGCATCTCCCCTG
GGACCAGCTGGAGGGCCACATGCACACACAGCCTAGCTGCCCCAGGGAGCTCTGCTGCCCTTGCTGGCCCTGCC
CTTCCCACAGGTGAGCAGGGCTCCTGTCCACCAGCACACTCAGTTCTCTTCCCTGCAGTGTTTTCATTTTATTTT
AGCCAAACATTTTGCCTGTTTTCTGTTTCAAACATGATAGTTGATATGAGACTGAAACCCCTGGGTTGTGGAGGG
AAATTGGCTCAGAGATGGACAACCTGGCAACTGTGAGTCCCTGCTTCCCGACACCAGCCTCATGGAATATGCAAC
AACTCCTGTACCCCAGTCCACGGTGTTCTGGCAGCAGGGACACCTGGGCCAATGGGCCATCTGGACCAAAGGTGG
GGTGTGGGGCCCTGGATGGCAGCTCTGGCCCAGACATGAATACCTCGTGTTCCTCCTCCCTCTATTACTGTTTCA
CCAGAGCTGTCTTAGCTCAAATCTGTTGTGTTTCTGAGTCTAGGGTCTGTACACTTGTTTATAATAAATGCAATC
GTTTGGAAAAAAAAAAAAAAAAAAAAAAAAAAAAAAAA
```

FIGURE 240

MPPQPGCQQQPTQCSTHHLNQPSPWAHRLTTRPWLEEQPRPTPPASLLTTRPTWMPRSGPLSIPWPLWLPLGYVV
CVREWCAGAVPYAPCVLCVSCLYMWLPLMLTRWGTILARVGWDQTLFSSSPEIMLPKISSQTQRMGWWGAPCEVA
LRRWGPLQGTSGVLLQLTLG

FIGURE 241

CCGCTGCGTGTTTTCCTCTTGATCGGGAACTCCTGCTTCTCCTTGCCTCGAAATGGACCCCAACTGCTCCTGCTC
GCCTGTTGGCTCCTGTGCCTGTGCCGGCTCCTGCAAATGCAAAGAGTGCAAATGCACCTCCTGCAAGAAGAGCTG
CTGCTCCTGCTGCCCTGTGGGCTGTGCMAAGTGTGCCCAGGGCTGCATCTGCAAAGGGACGTCAGACAAGTGCAG
CTGCTGTGCCTGATGCCAGGACAGCTGTGCTCTCAGATGTAAATAGAGCAACCTATATAAACCTGGATTTTTTTT
TTTTTTTTTTGTACAACCCTGACCCGTTTGCTACATCTTTTTTTCTATGAAATATGTGAATGGCAATAAATTCA
TCTAGACTAAAAAAAAAAAAAAAAAAAAAAAAAAAAAAAAA

FIGURE 242

MDPNCSCSPVGSCACAGSCKCKECKCTSCKKSCCSCCPVGCAKCAQGCICKGTSDKCSCCA

FIGURE 243

```
TCCACCCAAGAGCAACCTGGAACTAAGTTATTCGGCAACGAACTGTTCCACTTTGTTGTGAGGCAATAGATGTGG
AAATTCCCTGACGAGGGGCTCTGTCCTCATACTTCCTGCGGAGCTTATTGTCGTAAGAATATCTGTCATCCTGCT
AATGTGCATTGAAAGGAGAGCAACGGGGCTGAGGCCGTGTCAGCACGATGACCCCAAACAGACCACCCTCCTGT
GTCTTGTGCTCTGTCTGGGCCAGAGGATTCAGGCACAGGAAGGGGACTTTCCCATGCCTTTCATATCTGCCAAAT
CGAGTCCTGTGATTCCCTTGGATGGATCTGTGAAAATCCAGTGCCAGGCCATTCGTGAAGCTTACCTGACCCAGC
TGATGATCATAAAAAACTCCACGTACCGAGAGATAGGCAGAAGACTGAAGTTTTGGAATGAGACTGATCCTGAGT
TCGTCATTGACCACATGGACGCAAACAAGGCAGGGCGCTATCAGTGCCAATATAGGATAGGGCACTACAGATTCC
GGTACAGTGACACCCTGGAGCTGGTAGTGACAGGCTTGTATGGCAAACCCTTCCTCTCTGCAGATCGGGGTCTGG
TGTTGATGCCAGGAGAGAATATTTCCCTCACGTGCAGCTCAGCACACATCCCATTTGATAGATTTTCACTGGCCA
AGGAGGGAGAACTTTCTCTGCCACAGCACCAAAGTGGGGAACACCCGGCCAACTTCTCTTTGGGTCCTGTGGACC
TCAATGTCTCAGGGATCTACAGGTGCTACGGTTGGTACAACAGGAGCCCCTACCTGTGGTCCTTCCCCAGTAATG
CCTTGGAGCTTGTGGTCACAGACTCCATCCACCAAGATTACACGACGCAGAACTTGATCCGCATGGCCGTGGCAG
GACTGGTCCTCGTGGCTCTCTTGGCCATACTGGTTGAAAATTGGCACAGCCATACGGCACTGAACAAGGAAGCCT
CGGCAGATGTGGCTGAACCGAGCTGGAGCCAACAGATGTGTCAGCCAGGATTGACCTTTGCACGAACACCAAGTG
TCTGCAAGTAAACACCTGGAGGTGAAGGCAGAGAGGAGCCAGGACTGTGGAGTCCGACAAAGCTACTTGAAGGAC
ACAAGAGAGAAAAGCTCACTAAGAAGCTTGAATCTACTTTTTTTTTTTTGAGACAGAGTCTGGCTCTGTCACC
CAGGCTGGAGTGCAGTGGAGCAATCTCGGCTCATTGAACCTCTTGGGTTCAAGTGATTCTTGTGCCTCAGCCTCC
CAAGTAGCTGGAATTACAGGCACATACCACTGCACCCAGCTAATTTTTGTATTTTTAGTAGAGATGGGGTTTCAC
TGTGTTGGCCAGGCTGGTCTCGAACTCCTGACCTCAGGTGATCCACCCACCTTGGCCTCCCAAAGTGCTGAGATT
ATAGGCATGAGCCACCACGCCTGGCCAGATGCATGTTCAAACCAATCAAATGGTGTTTTCTTATGCAGGACTGAT
CGATTTGCACCCACCTTTCTGCACATAAGTTATGGTTTTCCATCTTATCTGTCTTCTGATTTTTTATATCCTGTT
TAATTTCTTCCTTCATTGTTCTTCTCTTTTTTATTTATTTTATTTATTTTATTTTATTTTATTTGAGACAG
AGTCTCACTCTGTTGCCCAGG
```

FIGURE 244

MDPKQTTLLCLVLCLGQRIQAQEGDFPMPFISAKSSPVIPLDGSVKIQCQAIREAYLTQLMIIKNSTYREIGRRL
KFWNETDPEFVIDHMDANKAGRYQCQYRIGHYRFRYSDTLELVVTGLYGKPFLSADRGLVLMPGENISLTCSSAH
IPFDRFSLAKEGELSLPQHQSGEHPANFSLGPVDLNVSGIYRCYGWYNRSPYLWSFPSNALELVVTDSIHQDYTT
QNLIRMAVAGLVLVALLAILVENWHSHTALNKEASADVAEPSWSQQMCQPGLTFARTPSVCK

FIGURE 245

GGATCTTAACACCACGCCTTGAGCAAGTCGCAAGAGCGGGAGGACACAGACCAGGAACCGAGAAGGGACAAGCAC
ATGGAAGCCAGCCCAGCATCCGGGCCCAGACACTTGATGGATCCACACATATTCACTTCCAACTTTAACAATGGC
ATTGGAAGGCATAAGACCTACCTGTGCTACGAAGTGGAGCGCCTGGACAATGGCACCTCGGTCAAGATGGACCAG
CACAGGGGCTTTCTACACAACCAGGCTAAGAATCTTCTCTGTGGCTTTTACGGCCGCCATGCGGAGCTGCGCTTC
TTGGACCTGGTTCCTTCTTTGCAGTTGGACCCGGCCCAGATCTACAGGGTCACTTGGTTCATCTCCTGGAGCCCC
TGCTTCTCCTGGGGCTGTGCCGGGGAAGTGCGTGCGTTCCTTCAGGAGAACACACACGTGAGACTGCGCATCTTC
GCTGCCCGCATCTATGATTACGACCCCCTATATAAGGAGGCGCTGCAAATGCTGCGGGATGCTGGGGCCCAAGTC
TCCATCATGACCTACGATGAATTTAAGCACTGCTGGGACACCTTTGTGGACCACCAGGGATGTCCCTTCCAGCCC
TGGGATGGACTAGATGAGCACAGCCAAGCCCTGAGTGGGAGGCTGCGGGCCATTCTCCAGAATCAGGGAAACTGA

AGGATGGGCCTCAGTCTCTAAGGAAGGCAGAGACCTGGGTTGAGCAGCAGAATAAAAGATCTTCTTCCAAGAAAT
GCAAACAGACCGTTCACCACCATCTCCAGCTGCTCACAGACGCCAGCAAAGCAGTATGCTCCCGATCAAGTAGAT
TTTTAAAAAATCAGAGTGGGCCGGGCGCGGCTGCACGCCTGTAATCCCAGCACTTTGGAGGCCAAGGCGGGTGGA
TCACGAGGTCAGGAGATCGAGACCATCCTGGCTAACACGGTGAAACCCTGTCTCTACTAAAAATACAAAAAATTA
GCCAGGGGTGGTGCGGGCGCCTGTAGTCCCAGCTACTCTGGAGGCTGAGGCAGGAGAGTACGTGAACCCGGGAGG
CAGAGCTTGCGGTGAGCCGAGATTGCGCTACTGCACTCCAGCCTGGGCGACAGXACCAGACTCCATCTCAAAAAA
AAAAAAAACCAGACTGAATTAATTTTAACTGAAAATTTCTCTTATGTTCCAAGGTACACAATAGGTAAGATTATG
CTCAATATTCTCAGAATAATTTTCAATGTATTAATGAAATGAAATGATAATTTGGCTTCATATCTAGACTAACAC
AAAATTAAGAATCTTCCATAATTGCTTTTGCTCAGTAACTGTGTCATGAATTGCAAGAGTTTCCACAAACACT

FIGURE 246

MEASPASGPRHLMDPHIFTSNFNNGIGRHKTYLCYEVERLDNGTSVKMDQHRGFLHNQAKNLLCGFYGRHAELRF
LDLVPSLQLDPAQIYRVTWFISWSPCFSWGCAGEVRAFLQENTHVRLRIFAARIYDYDPLYKEALQMLRDAGAQV
SIMTYDEFKHCWDTFVDHQGCPFQPWDGLDEHSQALSGRLRAILQNQGN

FIGURE 247

```
GAGGGCGCCATGAGGAGCCTGTGCTGCGCCCCACTCCTGCTCCTCTTGCTGCTGCCGCCGCTGCTGCTCACGCCC
CGCGCTGGGGACGCCGCCGTGATCACCGGGGCTTGTGACAAGGACTCCCAATGTGGTGGAGGCATGTGCTGTGCT
GTCAGTATCTGGGTCAAGAGCATAAGGATTTGCACACCTATGGGCAAACTGGGAGACAGCTGCCATCCACTGACT
CGTAAAGTTCCATTTTTTGGGCGGAGGATGCATCACACTTGCCCATGTCTGCCAGGCTTGGCCTGTTTACGGACT
TCATTTAACCGATTTATTTGTTTAGCCCAAAAGTAATCGCTCTGGAGTAGAAACCAAATGTGAATAGCCACATCT
TACCTGTAAAGTCTTACTTGTGATTGTGCCAAACAAAAAATGTGCCAGAAAGAAATGCTCTTGCTTCCTCAACTT
TCCAAGTAACATTTTTATCTTTGATTTGTAAATGATTTTTTTTTTTTTTTATCGAAAGAGAATTTTACTTTTG
GATAGAAATATGAAGTGTAAGGCATTATGGAACTGGTTCTTATTTCCCTGTTTGTGTTTTGGTTTGATTTGGCTT
TTTTCTTAAATGTCAAAAACGTACCCATTTTCACAAAAATGAGGAAAATAAGAATTTGATATTTGTTAGAAAAA
CTTTTTTTTTTTTTCTCACCACCCCAAGCCCCATTTGTGCCCTGCCGCACAAATACACCTACAGCTTTTGGTCC
CTTGCCTCTTCCACCTCAAAGAATTTCAAGGCTCTTACCTTACTTTATTTTTGTCCATTTCTCTTCCCTCCTCTT
GCATTTTAAAGTGGAGGGTTTGTCTCTTTGAGTTTGATGGCAGAATCACTGATGGGAATCCAGCTTTTTGCTGGC
ATTTAAATAGTGAAAAGAGTGTATATGTGAACTTGACACTCCAAACTCCTGTCATGGCACGGAAGCTAGGAGTGC
TGCTGGACCCTTCCTAAACCTGTCACTCAAGAGGACTTCAGCTCTGCTGTTGGGCTGGTGTGTGGACAGAAGGAA
TGGAAAGCCAAATTAATTTAGTCCAGATTTCTAGGTTTGGGTTTTTCTAAAAATAAAAGATTACATTTACTTCTT
TTACTTTTTATAAAGTTTTTTTTCCTTAGTCTCCTACTTAGAGATATTCTAGAAAATGTCACTTGAAGAGGAAGT
ATTTATTTTAATCTGGCACAACACTAATTACCATTTTTAAAGCGGTATTAAGTTGTAATTTAAACCTTGTTTGTA
ACTGAAAGGTCGATTGTAATGGATTGCCGTTTGTACCTGTATCAGTATTGCTGTGTAAAAATTCTGTATCAGAAT
AATAACAGTACTGTATATCATTTGATTTATTTTAATATTATATCCTTATTTTTGTC
```

FIGURE 248

MRSLCCAPLLLLLLLPPLLLTPRAGDAAVITGACDKDSQCGGGMCCAVSIWVKSIRICTPMGKLGDSCHPLTRKV
PFFGRRMHHTCPCLPGLACLRTSFNRFICLAQK

FIGURE 249

```
TCGACCCACGCGTCCGCCCACGCGTCCGCTTAATATCTGTATTCCCAGTTGCCTACGGGATAAAAGCCCAAACTC
CTTAGCAGAGAATATAAGGCCCTAGCTCCCACATTATTTCAGCAGTCATCACCCACTATGTTCCTCAAGACTGCA
GCCATTAACTTTTTAGAGTTCCCTAAACATGCTGTTTACTTTCATGCCTCTATCCCGTTGTCTGTGGAATGACTT
CCCTCCTTGCCCTTTTCAGTGCTACAAACCCCTATTCTTTAAGACATAGTACAAATGGCATCTCCTGGTTGGCAT
CTTTCCTGCAGGCCTACAGGCCTAGTAAGTATCTTCCTCCTCTGTGCTCCTGCATACCTCCATTCCTTTGTTATG
ACATCTATAACTTTAATAAGTACTAAAATCTGTAGTCCTACAAAACTCAGGCATAGAACTCATTTCCTTTATGGY
TCTATAATGGAACTTTACCCAACTCTCACGTTCCCCATGACCACAGATGTGGAAAATTTGAATCTTGACAGTTCA
AGGTGAACTCAGTCATTTTCAGAGTTTTCATAGTCCCTTCAAGATTGAAACTCAGTTCCTGCAATGTTTGCCCCT
TTTCTCCTCTTTTGTCTATGCTGGGAGAGGCATTGTGGGGAGGGTTGTCTGGCTTATGGCTCCCATTGTCCTCTG
CTTGATAAACCACCTGAGCTTTGGTCATTAGCAGTCTCCTGTGCCTTTCACACTCAGGTAGTGTCTGCACAGGCC
ACTCTATGTCTTTTCCATGCTGAAGAAATTCCTTTCCAGGCCATGTCTGTGTTCCTCCTGCCACACAGGAAATTT
TTGAGCATGTTCATCCTCCAAGCTGAATGCAGGGTCTTGGGTAGTGGTCCTCACCTGCTCCAGAGACTTCTCCAG
CCATTGCCACTCTCCACTCAGGTGATGAAGCTGGATGAGGGACTGCACCCACCAGAGTCAGGCCAGGGTCCTGTC
TGCTCTGTGAGTCCCTCCAATTGTTCTTATTCCGAGATTTCCATTGTTCTGCCCCCTCTTGACTCCCAGGGCTCT
CAAGGGAGTGGGGGTAGTGAAGGGAGCCCTTTCCCAAGCTCCCCCAAGAGCTCTAGTCACATCACTTCTGATACT
TCTTTTCCCACCAGCTGGAAGAAAGAACTTTCATTTGTCTTGAAATGAGAAAAATGTTCTTAGAATATTTTGTAT
TACTCTCTGCTCTGTCATTTATGGTAAACAAAATAAAATAATAAAAAAAAAAAAAAAAAAAAAAAAAGGGCGGC
C
```

FIGURE 250

MASPGWHLSCRPTGLVSIFLLCAPAYLHSFVMTSITLISTKICSPTKLRHRTHFLYGSIMELYPTLTFPMTTDVE
NLNLDSSR

FIGURE 251

AGAGAGCTGTTTACTAGGCACGACTGCGAAGGCAAGGGGGCACCAGCTCAGGACTGCATCTGCCTGCCATTTCCC
TTCCACTCCTCCTTTCTGGAGTCTGACATTAGAAAGCCAGCGAGAAGGAAGATTCAAACAACCAACCCTGATTTC
CTGCTTCTCCTTTTCATGAGTGTTCCTGTGGTCTCTGCACCTCCTTTCTGTCCCCCGGCAGAGGGCAGTAGAG<u>AT</u>
<u>G</u>GCCGGCCCAAGGCCTCGGTGGCGCGACCAGCTGCTGTTCATGAGCATCATAGTCCTCGTGATTGTGGTCATCTG
CCTGATGTTATACGCTCTTCTCTGGGAGGCTGGCAACCTCACTGACCTGCCCAACCTGAGAATCGGCTTCTATAA
CTTCTGCCTGTGGAATGAGGACACCAGCACCCTACAGTGTCACCAGTTCCCTGAGCTGGAAGCCCTGGGGGTGCC
TCGGGTTGGCCTGGGCCTGGCCAGGCTTGGCGTGTACGGGTCCCTGGTCCTCACCCTCTTTGCCCCCCAGCCTCT
CCTCCTAGCCCAGTGCAACAGTGATGAGAGAGCGTGGCGGCTGGCAGTGGGCTTCCTGGCTGTGTCCTCTGTGCT
GCTGGCAGGCGGCCTGGGCCTCTTCCTCTCCTATGTGTGGAAGTGGGTCAGGCTCTCCCTCCCGGGGCCTGGGTT
TCTAGCTCTGGGCAGCGCCCAGGCCTTACTCATCCTCTTGCTTATAGCCATGGCTGTGTTCCCTCTGAGGGCTGA
GAGGGCTGAGAGCAAGCTTGAGAGCTGC<u>TAA</u>AGGCTTACGTGATTGCAAGGGTTCAGTTCCAACCATAGTCAGAG
GTGGCACATCTGCTCAGCCATCTCATTTTACAGCTAACGCTGATCTCCAGCTCCAGCGATGGAACCCACTACAGA
GGAGGTGGGGCCCCTGTGTCAAAGAGGCCGAGGGGCAGCAAGGGCAGCCAGGGCACCTGTGACTTCTTAGTACAA
GATTGTCTGTCCTTCAGGACTTCCAAGGCTCCCAAAGACTCCCTAAACCATGCAGCTCATTGTCACACCAATTCC
TGCTTTAATTAATGGATCTGAGCAAATCTTCCTCTAGCTTCAGGAGGGTGGGGAGGGAGTGATTGCCGTCATGGG
GCCAGACTTCCAGGCTGATTTGCCAAATGCCAAAATGAAACCTAGCAAAGAACTTACGGCAACAAACGAGGACAT
TAAAAGAGCGAGCACCTCAGTGTCTCTGGGGACATGGTTAAGGAGCTTCCACTCAGCCCACCATAGTGAGTGGGC
CGCCATAAGCCATCACTGGAACTCCAACCCCAGAGGTCCAGGAGTGATCTCTGAGTGACTCAACAAAGACAGGAC
ACATGGGGTACAAAGACAAGGCTTGACTGCTTCAAAGCTTCCCTGGACCTGAAGCCAGACAGGGCAGAGGCGTCC
GCTGACAAATCACTCCCATGATGAGACCCTGGAGGACTCCAAATCCTCGCTGTGAACAGGACTGGACGGTTGCGC
ACAAACAAACGCTGCCACCCTCCACTTCCCAACCCAGAACTTGGAAAGACATTAGCACAACTTACGCATTGGGGA
ATTGTGTGTATTTTCTAGCACTTGTGTATTGGAAAACCTGTATGGCAGTGATTTATTCATATATTCCTGTCCAAA
GCCACACTGAAAACAGAGGCAGAGACATGT

FIGURE 252

MAGPRPRWRDQLLFMSIIVLVIVVICLMLYALLWEAGNLTDLPNLRIGFYNFCLWNEDTSTLQCHQFPELEALGV
PRVGLGLARLGVYGSLVLTLFAPQPLLLAQCNSDERAWRLAVGFLAVSSVLLAGGLGLFLSYVWKWVRLSLPGPG
FLALGSAQALLILLLIAMAVFPLRAERAESKLESC

FIGURE 253

```
CTGGGGTTTGGGGGACCGAGCCGCTCCGGGTTCGGGATGCTGAGGAGACCGCGGGCCCGCGCCAGCCTCCCACAC
ACACACACTCTCCCGGCGCCTCGGCCGGCCGGGCGCGGTGTGCAGGGGTGAGGCGGTGTCTCCAGGCTGAGGAGG
GACGCGGAGGAGGGTCCGGCGCGGCCCCGGGACTGGAGGGTGAGTCCCTCACAAAGGGCGGAGCGGGGCTGTCAC
CTGGAGATCACGGAGGGAAGTTCATCCATGAGCTCGGATTTCCCACATTACAACTTCAGGATGCCTAATATTGGA
TTCCAGAATCTGCCTCTCAACATATATATTGTGGTTTTTGGTACTGCTATATTTGTCTTCATCCTTAGTTTACTC
TTCTGTTGCTACTTGATTAGGCTAAGACATCAAGCACACAAAGAATTTTATGCCTACAAACAGGTTATATTAAAA
GAGAAAGTAAAAGAATTGAATTTACATGAGCTCTGTGCAGTGTGCCTAGAAGACTTCAAGCCTCGAGATGAGTTG
GGGATTTGCCCATGTAAGCACGCCTTCCACAGAAAGTGCCTTATTAAGTGGCTGGAGGTTCGTAAAGTGTGTCCC
CTGTGCAACATGCCAGTTCTACAGCTGGCCCAGTTGCACAGTAAGCAGGACCGTGGACCCCCTCAGGGGCCCCTT
CCTGGGGCAGAGAACATTGTATAGCTTACCGCAAGGATCAGACTGTTGCTGGACACGACGTCTGTGTGGAGCCAG
GAGGAACACATGTGGTGTCTGTATGGCTGCTCTCTACCTAGGACACCAGCTGCCACTTCTTTTGCCTCATGAAGA
ACTCTTGGGCCAGCCAAACTGGGAACCTAGGTGTCTGGGTCTTGTGACAACCAAAGCACTTTGACACTACCCCCT
GCCGAGAGAAGAGGAGTGGATGAGCCTGCGGGTTTGCCTCAAGAAACTTCATGAGGGTCTCTTACTAACTCCATT
ACACTCTCTCCTGGAGCCTCATCTCCATGTCAAGCAGGAGGGTAAAGAAGGGAACTAAGAGCAGGTCTTTCAA
GCCACACCCCCACCTGCGGATGGATGGGTTTCTCTGTAGGCCATGCAGGCCTTTGTCGCAGCAAACCTTCCCAGC
AGCCCTTGAGCCAAGTAAAACCAGCACAACCAGCCACCAGTGGTTGGTGAGGCAGTGCCCACAAGGCTCATGTTG
TATGCCTTTGATAAGGCCATCTTGGCTTTGAGTAGCAGTGTTCCTCGTCACCCATTTCCCCCTCAGGATTACAAC
ACCTGCTATCAAATCATCTAAGCTGAAAACATGAGATGCGCTTGGAAAGGCCTAGTCAGAAGCCATTTCCTCTTA
TCATTTCCCTCTCCTATGCACCAGTAAGGCCCGTCCAGAGCCCCAGCAGGGAGTGGGCCCTGAGTCCACACTGTC
CCTGAGTGATCCAGGAGGCTGCCCACATCCCCACATGTGCACTGTGGTTCCAGTGTAGCTGCTGTGAGCCCACTG
CCACTGCCTCAGAAGGGAGCCAGTGTGAACCTCTTGGCTCCAAAGAGCAGTGGCTTTTTGAGAATGGCCCATACT
TCTGGCCCGGCTGGATGAAGGGAATGCCGACCCTTTGGCCTCTCCCCCTCCTTCCATCTCTTCTCTCTCTTGCCC
TATCTCTCTTTCTACTTCAGAAAAAAAAAAAAAAAAAAAAAAA
```

FIGURE 254

MSSDFPHYNFRMPNIGFQNLPLNIYIVVFGTAIFVFILSLLFCCYLIRLRHQAHKEFYAYKQVILKEKVKELNLH
ELCAVCLEDFKPRDELGICPCKHAFHRKCLIKWLEVRKVCPLCNMPVLQLAQLHSKQDRGPPQGPLPGAENIV

FIGURE 255

GGGAATAGCAGAATAGGAGCAAGCCAGCACTAGTCAGCTAACTAAGTGACTCAACCAAGGCCTTTTTTCCTTGTT
ATCTTTGCAGATACTTCATTTTCTTAGCGTTTCTGGAGATTACAACATCCTGCGGTTCCGTTTCTGGGAACTTTA
CTGATTTATCTCCCCCCTCACACAAATAAGCATTGATTCCTGCATTTCTGAAGATCTCAAGATCTGGACTACTGT
TGAAAAAATTTCCAGTGAGGCTCAGTTATGTCTGTAAAGATGGGAAAAAAATACAAGAACATTGTTCTACTAAAA
GGATTAGAGGTCATCAATGATTATCATTTTAGAATGGTTAAGTCCTTACTGAGCAACGATTTAAAACTTAATTTA
AAAATGAGAGAAGAGTATGACAAAATTCAGATTGCTGACTTGATGGAAGAAAAGTTCCGAGGTGATGCTGGTTTG
GGCAAACTAATAAAAATTTTCGAAGATATACCAACGCTTGAAGACCTGGCTGAAACTCTTAAAAAAGAAAAGTTA
AAAGTAAAAGGACCAGCCCTATCAAGAAAGAGGAAGAAGGAAGTGCATGCTACTTCACCTGCACCCTCCACAAGC
AGCACTGTCAAAACTGAAGGAGCAGAGGCAACTCCTGGAGCTCAGAAAAGAAAAAAATCAACCAAAGAAAAGGCT
GGACCCAAAGGGAGTAAGGTGTCCGAGGAACAGACTCAGCCTCCCTCTCCTGCAGGAGCCGGCATGTCCACAGCC
ATGGGCCGTTCCCCATCTCCCAAGACCTCATTGTCAGCTCCACCCAACAGTTCTTCAACTGAGAACCCGAAAACA
GTGGCCAAATGTCAGGTAACTCCCAGAAGAAATGTTCTCCAAAAACGCCCAGTGATAGTGAAGGTACTGAGTACA
ACAAAGCCATTTGAATATGAGACCCCAGAAATGGAGAAAAAAATAATGTTTCATGCTACAGTGGCTACACAGACA
CAGTTCTTCCATGTGAAGGTTTTAAACACCAGCTTGAAGGAGAAATTCAATGGAAAGAAAATCATCATCATATCA
GATTATTTGGAATATGATAGTCTCCTAGAGGTCAATGAAGAATCTACTGTATCTGAAGCTGGTCCTAACCAAACG
TTTGAGGTTCCAAATAAAATCATCAACAGAGCAAAGGAAACTCTGAAGATTGATATTCTTCACAAACAAGCTTCA
GGAAATATTGTATATGGGGTATTTATGCTACATAAGAAAACAGTAAATCAGAAGACCACAATCTACGAAATTCAG
GATGATAGAGGAAAAATGGATGTAGTGGGGACAGGACAATGTCACAATATCCCCTGTGAAGAAGGAGATAAGCTC
CAGCTTTTCTGCTTTCGACTTAGAAAAAAGAACCAGATGTCAAAACTGATTTCAGAAATGCATAGTTTTATCCAG
ATAAAGAAAAAAACAAACCCGAGAAACAATGACCCCAAGAGCATGAAGCTACCCCAGGAACAGCGTCAGCTTCCA
TATCCTTCAGAGGCCAGCACAACCTTCCCTGAGAGCCATCTTCGGACTCCTCAGATGCCACCAACAACTCCATCC
AGCAGTTTCTTCACCAAGAAAAGTGAAGACACAATCTCCAAAATGAATGACTTCATGAGGATGCAGATACTGAAG
GAAGGGAGTCATTTTCCAGGACCGTTCATGACCAGCATAGGCCCAGCTGAGAGCCATCCCCACACTCCTCAGATG
CCTCCATCAACACCAAGCAGCAGTTTCTTAACCACGTTGAAACCAAGACTGAAGACTGAACCTGAAGAAGTTTCC
ATAGAAGACAGTGCCCAGAGTGACCTCAAAGAAGTGATGGTGCTGAACGCAACAGAATCATTTGTATATGAGCCC
AAAGAGCAGAAGAAAATGTTTCATGCCACAGTGGCAACTGAGAATGAAGTCTTCCGAGTGAAGGTTTTTAATATT
GACCTAAAGGAGAAGTTCACCCCAAAGAAGATCATTGCCATAGCAAATTATGTTTGCCGCAATGGGTTCCTGGAG
GTATATCCTTTCACACTTGTGGCTGATGTGAATGCTGACCGAAACATGGAGATCCCAAAAGGATTGATTAGAAGT
GCCAGCGTAACTCCTAAAATCAATCAGCTTTGCTCACAAACTAAAGGAAGTTTTGTGAATGGGGTGTTTGAGGTA
CATAAGAAAAATGTAAGGGGTGAATTCACTTATTATGAAATACAAGATAATACAGGGAAGATGGAAGTGGTGGTG
CATGGACGACTGAACACAATCAACTGTGAGGAAGGAGATAAACTGAAACTCACCAGCTTTGAATTGGCACCGAAA
AGTGGGAATACCGGGGAGTTGAGATCTGTAATTCATAGTCACATCAAGGTCATCAAGACCAGGAAAAACAAGAAA
GACATACTCAATCCTGATTCAAGTATGGAAACTTCACCAGACTTTTTCTTCTAAAATCTGGATGTCATTGACGAT
AATGTTTATGGAGATAAGGTCTAAGTCCCTAAAAAAATGTACATATACCTGGTTGAAATACAACACTATACATAC
ACACCACCATATATACTAGCTGTTAATCCTATGGAATGGGGGTATTGGGAGTGCTTTTTAATTTTTCATAGTTT
TTTTTTAATAAAATGGCATATTTTGCATCTACAACTTCTATAATAAGAAAAAATAAATAAACATTATCTTTTTG
TGAAAAAAA

FIGURE 256

```
MGKKYKNIVLLKGLEVINDYHFRMVKSLLSNDLKLNLKMREEYDKIQIADLMEEKFRGDAGLGKLIKIFEDIPTL
EDLAETLKKEKLKVKGPALSRKRKKEVHATSPAPSTSSTVKTEGAEATPGAQKRKKSTKEKAGPKGSKVSEEQTQ
PPSPAGAGMSTAMGRSPSPKTSLSAPPNSSSTENPKTVAKCQVTPRRNVLQKRPVIVKVLSTTKPFEYETPEMEK
KIMFHATVATQTQFFHVKVLNTSLKEKFNGKKIIIISDYLEYDSLLEVNEESTVSEAGPNQTFEVPNKIINRAKE
TLKIDILHKQASGNIVYGVFMLHKKTVNQKTTIYEIQDDRGKMDVVGTGQCHNIPCEEGDKLQLFCFRLRKKNQM
SKLISEMHSFIQIKKKTNPRNNDPKSMKLPQEQRQLPYPSEASTTFPESHLRTPQMPPTTPSSSFFTKKSEDTIS
KMNDFMRMQILKEGSHFPGPFMTSIGPAESHPHTPQMPPSTPSSSFLTTLKPRLKTEPEEVSIEDSAQSDLKEVM
VLNATESFVYEPKEQKKMFHATVATENEVFRVKVFNIDLKEKFTPKKIIAIANYVCRNGFLEVYPFTLVADVNAD
RNMEIPKGLIRSASVTPKINQLCSQTKGSFVNGVFEVHKKNVRGEFTYYEIQDNTGKMEVVVHGRLNTINCEEGD
KLKLTSFELAPKSGNTGELRSVIHSHIKVIKTRKNKKDILNPDSSMETSPDFFF
```

FIGURE 257

```
TGTCACTGAGGGTTGACTGACTGGAGAGCTCAAGTGCAGCAAAGAGAAGTGTCAGAGCATGAGCGCCAAGTCCAG
AACCATAGGGATTATTGGAGCTCCTTTCTCAAAGGGACAGCCACGAGGAGGGGTGGAAGAAGGCCCTACAGTATT
GAGAAAGGCTGGTCTGCTTGAGAAACTTAAAGAACAAGAGTGTGATGTGAAGGATTATGGGGACCTGCCCTTTGC
TGACATCCCTAATGACAGTCCCTTTCAAATTGTGAAGAATCCAAGGTCTGTGGGAAAAGCAAGCGAGCAGCTGGC
TGGCAAGGTGGCAGAAGTCAAGAAGAACGGAAGAATCAGCCTGGTGCTGGGCGGAGACCACAGTTTGGCAATTGG
AAGCATCTCTGGCCATGCCAGGGTCCACCCTGATCTTGGAGTCATCTGGGTGGATGCTCACACTGATATCAACAC
TCCACTGACAACCACAAGTGGAAACTTGCATGGACAACCTGTATCTTTCCTCCTGAAGGAACTAAAAGGAAAGAT
TCCCGATGTGCCAGGATTCTCCTGGGTGACTCCCTGTATATCTGCCAAGGATATTGTGTATATTGGCTTGAGAGA
CGTGGACCCTGGGGAACACTACATTTTGAAAACTCTAGGCATTAAATACTTTTCAATGACTGAAGTGGACAGACT
AGGAATTGGCAAGGTGATGGAAGAAACACTCAGCTATCTACTAGGAAGAAAGAAAAGGCCAATTCATCTAAGTTT
TGATGTTGACGGACTGGACCCATCTTTCACACCAGCTACTGGCACACCAGTCGTGGGAGGTCTGACATACAGAGA
AGGTCTCTACATCACAGAAGAAATCTACAAAACAGGGCTACTCTCAGGATTAGATATAATGGAAGTGAACCCATC
CCTGGGGAAGACACCAGAAGAAGTAACTCGAACAGTGAACACAGCAGTTGCAATAACCTTGGCTTGTTTCGGACT
TGCTCGGGAGGGTAATCACAAGCCTATTGACTACCTTAACCCACCTAAGTAAATGTGGAAACATCCGATATAAAT
CTCATAGTTAATGGCATAATTAGAAAGCTAATCATTTTCTTAAGCATAGAGTTATCCTTCTAAAGACTTGTTCTT
TCAGAAAAATGTTTTTCCAATTAGTATAAACTCTACAAATTCCCTCTTGGTGTAAAATTCAAGATGTGGAAATTC
TAACTTTTTGAAATTTAAAAGCTTATATTTCTAACTTGGCAAAAGACTTATCCTTAGAAAGAGAAGTGTACAT
TGATTTCCAATTAAAAATTTGCTGGCATTAAAAATAAGCACACTTACATAAGCCCCCATACATAGAGTGGGACTC
TTGGAATCAGGAGACAAAGCTACCACATGTGGAAAGGTACTATGTGTCCATGTCATTCAAAAAATGTGATTTTTT
ATAATAAACTCTTTATAACAAG
```

FIGURE 258

MSAKSRTIGIIGAPFSKGQPRGGVEEGPTVLRKAGLLEKLKEQECDVKDYGDLPFADIPNDSPFQIVKNPRSVGK
ASEQLAGKVAEVKKNGRISLVLGGDHSLAIGSISGHARVHPDLGVIWVDAHTDINTPLTTTSGNLHGQPVSFLLK
ELKGKIPDVPGFSWVTPCISAKDIVYIGLRDVDPGEHYILKTLGIKYFSMTEVDRLGIGKVMEETLSYLLGRKKR
PIHLSFDVDGLDPSFTPATGTPVVGGLTYREGLYITEEIYKTGLLSGLDIMEVNPSLGKTPEEVTRTVNTAVAIT
LACFGLAREGNHKPIDYLNPPK

FIGURE 259A

```
GGCCGGGACCCGCAGAGCCGAGCCGACCCTTCTCTCCCGGGCTGCGGCAGGGCAGGGCGGGGAGCTCCGCGCACC
AACAGAGCCGGTTCTCAGGGCGCTTTGCTCCTTGTTTTTCCCCGGTTCTGTTTTCTCCCCTTCTCCGGAAGGCT
TGTCAAGGGGTAGGAGAAAGAGACGCAAACACAAAAGTGGAAAACAGTTAATGACCAGCCACGGGCGTCCCTGCT
GTGAGCTCTGGCCGCTGCCTTCCAGGGCTCCCGAGCCACACGCTGGGCGTGCTGGCTGAGGGAACATGGCTTGTT
GGCCTCAGCTGAGGTTGCTGCTGTGGAAGAACCTCACTTTCAGAAGAAGACAAACATGTCAGCTGTTACTGGAAG
TGGCCTGGCCTCTATTTATCTTCCTGATCCTGATCTCTGTTCGGCTGAGCTACCCACCCTATGAACAACATGAAT
GCCATTTTCCAAATAAAGCCATGCCCTCTGCAGGAACACTTCCTTGGGTTCAGGGGATTATCTGTAATGCCAACA
ACCCCTGTTTCCGTTACCCGACTCCTGGGGAGGCTCCCGGAGTTGTTGGAAACTTTAACAAATCCATTGTGGCTC
GCCTGTTCTCAGATGCTCGGAGGCTTCTTTTATACAGCCAGAAAGACACCAGCATGAAGGACATGCGCAAAGTTC
TGAGAACATTACAGCAGATCAAGAAATCCAGCTCAAACTTGAAGCTTCAAGATTTCCTGGTGGACAATGAAACCT
TCTCTGGGTTCCTATATCACAACCTCTCTCTCCCAAAGTCTACTGTGGACAAGATGCTGAGGGCTGATGTCATTC
TCCACAAGGTATTTTTGCAAGGCTACCAGTTACATTTGACAAGTCTGTGCAATGGATCAAAATCAGAAGAGATGA
TTCAACTTGGTGACCAAGAAGTTTCTGAGCTTTGTGGCCTACCAAAGGAGAAACTGGCTGCAGCAGAGCGAGTAC
TTCGTTCCAACATGGACATCCTGAAGCCAATCCTGAGAACACTAAACTCTACATCTCCCTTCCCGAGCAAGGAGC
TGGCTGAAGCCACAAAAACATTGCTGCATAGTCTTGGGACTCTGGCCCAGGAGCTGTTCAGCATGAGAAGCTGGA
GTGACATGCGACAGGAGGTGATGTTTCTGACCAATGTGAACAGCTCCAGCTCCTCCACCCAAATCTACCAGGCTG
TGTCTCGTATTGTCTGCGGGCATCCCGAGGGAGGGGGGCTGAAGATCAAGTCTCTCAACTGGTATGAGGACAACA
ACTACAAAGCCCTCTTTGGAGGCAATGGCACTGAGGAAGATGCTGAAACCTTCTATGACAACTCTACAACTCCTT
ACTGCAATGATTTGATGAAGAATTTGGAGTCTAGTCCTCTTTCCCGCATTATCTGGAAAGCTCTGAAGCCGCTGC
TCGTTGGGAAGATCCTGTATACACCTGACACTCCAGCCACAAGGCAGGTCATGGCTGAGGTGAACAAGACCTTCC
AGGAACTGGCTGTGTTCCATGATCTGGAAGGCATGTGGGAGGAACTCAGCCCCAAGATCTGGACCTTCATGGAGA
ACAGCCAAGAAATGGACCTTGTCCGGATGCTGTTGGACAGCAGGGACAATGACCACTTTTGGGAACAGCAGTTGG
ATGGCTTAGATTGGACAGCCCAAGACATCGTGGCGTTTTTGGCCAAGCACCCAGAGGATGTCCAGTCCAGTAATG
GTTCTGTGTACACCTGGAGAGAAGCTTTCAACGAGACTAACCAGGCAATCCGGACCATATCTCGCTTCATGGAGT
GTGTCAACCTGAACAAGCTAGAACCCATAGCAACAGAAGTCTGGCTCATCAACAAGTCCATGGAGCTGCTGGATG
AGAGGAAGTTCTGGGCTGGTATTGTGTTCACTGGAATTACTCCAGGCAGCATTGAGCTGCCCCATCATGTCAAGT
ACAAGATCCGAATGGACATTGACAATGTGGAGAGGACAAATAAAATCAAGGATGGGTACTGGGACCCTGGTCCTC
GAGCTGACCCCTTTGAGGACATGCGGTACGTCTGGGGGGGCTTCGCCTACTTGCAGGATGTGGTGGAGCAGGCAA
TCATCAGGGTGCTGACGGGCACCGAGAAGAAAACTGGTGTCTATATGCAACAGATGCCCTATCCCTGTTACGTTG
ATGACATCTTTCTGCGGGTGATGAGCCGGTCAATGCCCCTCTTCATGACGCTGGCCTGGATTACTCAGTGGCTG
TGATCATCAAGGGCATCGTGTATGAGAAGGAGGCACGGCTGAAAGAGACCATGCGGATCATGGGCCTGGACAACA
GCATACTCTGGTTTAGCTGGTTCATTAGTAGCCTCATTCCTCTTCTTGTGAGCGCTGGCCTGCTAGTGGTCATCC
TGAAGTTAGGAAACCTGCTGCCCTACAGTGATCCCAGCGTGGTGTTTGTCTTCCTGTCCGTGTTTGCTGTGGTGA
CAATCCTGCAGTGCTTCCTGATTAGCACACTCTTCTCCAGAGCCAACCTGGCAGCAGCCTGTGGGGGCATCATCT
ACTTCACGCTGTACCTGCCCTACGTCCTGTGTGTGGCATGGCAGGACTACGTGGGCTTCACACTCAAGATCTTCG
CTAGCCTGCTGTCTCCTGTGGCTTTTGGGTTTGGCTGTGAGTACTTTGCCCTTTTTGAGGAGCAGGGCATTGGAG
TGCAGTGGGACAACCTGTTTGAGAGTCCTGTGGAGGAAGATGGCTTCAATCTCACCACTTCGATCTCCATGATGC
TGTTTGACACCTTCCTCTATGGGGTGATGACCTGGTACATTGAGGCTGTCTTTCCAGGCCAGTACGGAATTCCCA
GGCCCTGGTATTTTCCTTGCACCAAGTCCTACTGGTTTGGCGAGGAAAGTGATGAGAAGAGCCACCCTGGTTCCA
ACCAGAAGAGAATGTCAGAAATCTGCATGGAGGAGGAACCCACCCACTTGAAGCTGGGCGTGTCCATTCAGAACC
TGGTAAAAGTCTACCGAGATGGGATGAAGGTGGCTGTCGATGGCCTGGCACTGAATTTTTATGAGGGCCAGATCA
CCTCCTTCCTGGGCCACAATGGAGCGGGGAAGACGACCACCATGTCAATCCTGACCGGGTTGTTCCCCCCGACCT
CGGGCACCGCCTACATCCTGGGAAAAGACATTCGCTCTGAGATGAGCACCATCCGGCAGAACCTGGGGGTCTGTC
CCCAGCATAACGTGCTGTTTGACATGCTGACTGTCGAAGAACACATCTGGTTCTATGCCCGCTTGAAAGGGCTCT
CTGAGAAGCACGTGAAGGCGGAGATGGAGCAGATGGCCCTGGATGTTGGTTTGCCATCAAGCAAGCTGAAAAGCA
AAACAAGCCAGCTGTCAGGTGGAATGCAGAGAAAGCTATCTGTGGCCTTGGCCTTTGTCGGGGGATCTAAGGTTG
TCATTCTGGATGAACCCACAGCTGGTGTGGACCCTTACTCCCGCAGGGGAATATGGGAGCTGCTGCTGAAATACC
GACAAGGCCGCACCATTATTCTCTCTACACACCACATGGATGAAGCGGACGTCCTGGGGGACAGGATTGCCATCA
```

FIGURE 259B

```
TCTCCCATGGGAAGCTGTGCTGTGTGGGCTCCTCCCTGTTTCTGAAGAACCAGCTGGGAACAGGCTACTACCTGA
CCTTGGTCAAGAAAGATGTGGAATCCTCCCTCAGTTCCTGCAGAAACAGTAGTAGCACTGTGTCATACCTGAAAA
AGGAGGACAGTGTTTCTCAGAGCAGTTCTGATGCTGGCCTGGGCAGCGACCATGAGAGTGACACGCTGACCATCG
ATGTCTCTGCTATCTCCAACCTCATCAGGAAGCATGTGTCTGAAGCCCGGCTGGTGGAAGACATAGGGCATGAGC
TGACCTATGTGCTGCCATATGAAGCTGCTAAGGAGGGAGCCTTTGTGGAACTCTTTCATGAGATTGATGACCGGC
TCTCAGACCTGGGCATTTCTAGTTATGGCATCTCAGAGACGACCCTGGAAGAAATATTCCTCAAGGTGGCCGAAG
AGAGTGGGGTGGATGCTGAGACCTCAGATGGTACCTTGCCAGCAAGACGAAACAGGCGGGCCTTCGGGGACAAGC
AGAGCTGTCTTCGCCCGTTCACTGAAGATGATGCTGCTGATCCAAATGATTCTGACATAGACCCAGAATCCAGAG
AGACAGACTTGCTCAGTGGGATGGATGGCAAAGGGTCCTACCAGGTGAAAGGCTGGAAACTTACACAGCAACAGT
TTGTGGCCCTTTTGTGGAAGAGACTGCTAATTGCCAGACGGAGTCGGAAAGGATTTTTTGCTCAGATTGTCTTGC
CAGCTGTGTTTGTCTGCATTGCCCTTGTGTTCAGCCTGATCGTGCCACCCTTTGGCAAGTACCCCAGCCTGGAAC
TTCAGCCCTGGATGTACAACGAACAGTACACATTTGTCAGCAATGATGCTCCTGAGGACACGGGAACCCTGGAAC
TCTTAAACGCCCTCACCAAAGACCCTGGCTTCGGGACCCGCTGTATGGAAGGAAACCCAATCCCAGACACGCCCT
GCCAGGCAGGGGAGGAAGAGTGGACCACTGCCCCAGTTCCCCAGACCATCATGGACCTCTTCCAGAATGGGAACT
GGACAATGCAGAACCCTTCACCTGCATGCCAGTGTAGCAGCGACAAAATCAAGAAGATGCTGCCTGTGTGTCCCC
CAGGGGCAGGGGGGCTGCCTCCTCCACAAAGAAAACAAAACACTGCAGATATCCTTCAGGACCTGACAGGAAGAA
ACATTTCGGATTATCTGGTGAAGACGTATGTGCAGATCATAGCCAAAAGCTTAAAGAACAAGATCGGGTGAATG
AGTTTAGGTATGGCGGCTTTTCCCTGGGTGTCAGTAATACTCAAGCACTTCCTCCGAGTCAAGAAGTTAATGATG
CCATCAAACAAATGAAGAAACACCTAAAGCTGGCCAAGGACAGTTCTGCAGATCGATTTCTCAACAGCTTGGGAA
GATTTATGACAGGACTGGACACCAGAAATAATGTCAAGGTGTGGTTCAATAACAAGGGCTGGCATGCAATCAGCT
CTTTCCTGAATGTCATCAACAATGCCATTCTCCGGGCCAACCTGCAAAAGGGAGAGAACCCTAGCCATTATGGAA
TTACTGCTTTCAATCATCCCCTGAATCTCACCAAGCAGCAGCTCTCAGAGGTGGCTCTGATGACCACATCAGTGG
ATGTCCTTGTGTCCATCTGTGTCATCTTTGCAATGTCCTTCGTCCCAGCCAGCTTTGTCGTATTCCTGATCCAGG
AGCGGGTCAGCAAAGCAAAACACCTGCAGTTCATCAGTGGAGTGAAGCCTGTCATCTACTGGCTCTCTAATTTTG
TCTGGGATATGTGCAATTACGTTGTCCCTGCCACACTGGTCATTATCATCTTCATCTGCTTCCAGCAGAAGTCCT
ATGTGTCCTCCACCAATCTGCCTGTGCTAGCCCTTCTACTTTGCTGTATGGGTGGTCAATCACACCTCTCATGT
ACCCAGCCTCCTTTGTGTTCAAGATCCCCAGCACAGCCTATGTGGTGCTCACCAGCGTGAACCTCTTCATTGGCA
TTAATGGCAGCGTGGCCACCTTTGTGCTGGAGCTGTTCACCGACAATAAGCTGAATAATATCAATGATATCCTGA
AGTCCGTGTTCTTGATCTTCCCACATTTTTGCCTGGGACGAGGGCTCATCGACATGGTGAAAAACCAGGCAATGG
CTGATGCCCTGGAAAGGTTTGGGGAGAATCGCTTTGTGTCACCATTATCTTGGGACTTGGTGGGACGAAACCTCT
TCGCCATGGCCGTGGAAGGGGTGGTGTTCTTCCTCATTACTGTTCTGATCCAGTACAGATTCTTCATCAGGCCCA
GACCTGTAAATGCAAAGCTATCTCCTCTGAATGATGAAGATGAAGATGTGAGGCGGGAAAGACAGAGAATTCTTG
ATGGTGGAGGCCAGAATGACATCTTAGAAATCAAGGAGTTGACGAAGATATATAGAAGGAAGCGGAAGCCTGCTG
TTGACAGGATTTGCGTGGGCATTCCTCCTGGTGAGTGCTTTGGGCTCCTGGGAGTTAATGGGCTGGAAAATCAT
CAACTTTCAAGATGTTAACAGGAGATACCACTGTTACCAGAGGAGATGCTTTCCTTAACAAAAATAGTATCTTAT
CAAACATCCATGAAGTACATCAGAACATGGGCTACTGCCCTCAGTTTGATGCCATCACAGAGCTGTTGACTGGGA
GAGAACACGTGGAGTTCTTTGCCCTTTTGAGAGGAGTCCCAGAGAAAGAAGTTGGCAAGGTTGGTGAGTGGGCGA
TTCGGAAACTGGGCCTCGTGAAGTATGGAGAAAAATATGCTGGTAACTATAGTGGAGGCAACAAACGCAAGCTCT
CTACAGCCATGGCTTTGATCGGCGGGCCTCCTGTGGTGTTTCTGGATGAACCCACCACAGGCATGGATCCCAAAG
CCCGGCGGTTCTTGTGGAATTGTGCCCTAAGTGTTGTCAAGGAGGGGAGATCAGTAGTGCTTACATCTCATAGTA
TGGAAGAATGTGAAGCTCTTTGCACTAGGATGGCAATCATGGTCAATGGAAGGTTCAGGTGCCTTGGCAGTGTCC
AGCATCTAAAAAATAGGTTTGGAGATGGTTATACAATAGTTGTACGAATAGCAGGGTCCAACCCGGACCTGAAGC
CTGTCCAGGATTTCTTTGGACTTGCATTTCCTGGAAGTGTTCTAAAAGAGAAACACCGGAACATGCTACAATACC
AGCTTCCATCTTCATTATCTTCTCTGGCCAGGATATTCAGCATCCTCTCCCAGAGCAAAAAGCGACTCCACATAG
AAGACTACTCTGTTTCTCAGACAACACTTGACCAAGTATTTGTGAACTTTGCCAAGGACCAAAGTGATGATGACC
ACTTAAAAGACCTCTCATTACACAAAAACCAGACAGTAGTGGACGTTGCAGTTCTCACATCTTTTCTACAGGATG
AGAAAGTGAAAGAAAGCTATGTATGAAGAATCCTGTTCATACGGGGTGGCTGAAAGTAAAGAGGAACTAGACTTT
CCTTTGCACCATGTGAAGTGTTGTGGAGAAAAGAGCCAGAAGTTGATGTGGGAAGAAGTAAACTGGATACTGTAC
```

FIGURE 259C

```
TGATACTATTCAATGCAATGCAATTCAATGCAATGAAAACAAAATTCCATTACAGGGGCAGTGCCTTTGTAGCCT
ATGTCTTGTATGGCTCTCAAGTGAAAGACTTGAATTTAGTTTTTTACCTATACCTATGTGAAACTCTATTATGGA
ACCCAATGGACATATGGGTTTGAACTCACACTTTTTTTTTTTTTGTTCCTGTGTATTCTCATTGGGGTTGCAA
CAATAATTCATCAAGTAATCATGGCCAGCGATTATTGATCAAAATCAAAAGGTAATGCACATCCTCATTCACTAA
GCCATGCCATGCCCAGGAGACTGGTTTCCCGGTGACACATCCATTGCTGGCAATGAGTGTGCCAGAGTTATTAGT
GCCAAGTTTTTCAGAAAGTTTGAAGCACCATGGTGTGTCATGCTCACTTTTGTGAAAGCTGCTCTGCTCAGAGTC
TATCAACATTGAATATCAGTTGACAGAATGGTGCCATGCGTGGCTAACATCCTGCTTTGATTCCCTCTGATAAGC
TGTTCTGGTGGCAGTAACATGCAACAAAAATGTGGGTGTCTCTAGGCACGGGAAACTTGGTTCCATTGTTATATT
GTCCTATGCTTCGAGCCATGGGTCTACAGGGTCATCCTTATGAGACTCTTAAATATACTTAGATCCTGGTAAGAG
GCAAAGAATCAACAGCCAAACTGCTGGGGCTGCAAGCTGCTGAAGCCAGGGCATGGGATTAAAGAGATTGTGCGT
TCAAACCTAGGGAAGCCTGTGCCCATTTGTCCTGACTGTCTGCTAACATGGTACACTGCATCTCAAGATGTTTAT
CTGACACAAGTGTATTATTTCTGGCTTTTGAATTAATCTAGAAAATGAAAAGATGGAGTTGTATTTTGACAAAA
ATGTTTGTACTTTTAATGTTATTTGGAATTTTAAGTTCTATCAGTGACTTCTGAATCCTTAGAATGGCCTCTTT
GTAGAACCCTGTGGTATAGAGGAGTATGGCCACTGCCCACTATTTTTATTTCTTATGTAAGTTTGCATATCAG
TCATGACTAGTGCCTAGAAAGCAATGTGATGGTCAGGATCTCATGACATTATATTTGAGTTTCTTTCAGATCATT
TAGGATACTCTTAATCTCACTTCATCAATCAAATATTTTTGAGTGTATGCTGTAGCTGAAAGAGTATGTACGTA
CGTATAAGACTAGAGAGATATTAAGTCTCAGTACACTTCCTGTGCCATGTTATTCAGCTCACTGGTTTACAAATA
TAGGTTGTCTTGTGGTTGTAGGAGCCCACTGTAACAATATTGGGCAGCCTTTTTTTTTTTTTTTAATTGCAACA
ATGCAAAAGCCAAGAAAGTATAAGGGTCACAAGTTTAAACAATGAATTCTTCAACAGGGAAAACAGCTAGCTTGA
AAACTTGCTGAAAAACACAACTTGTGTTTATGGCATTTAGTACCTTCAAATAATTGGCTTTGCAGATATTGGATA
CCCCATTAAATCTGACAGTCTCAAATTTTTCATCTCTTCAATCACTAGTCAAGAAAAATATAAAAACAACAAATA
CTTCCATATGGAGCATTTTTCAGAGTTTTCTAACCCAGTCTTATTTTTCTAGTCAGTAAACATTTGTAAAAATAC
TGTTTCACTAATACTTACTGTTAACTGTCTTGAGAGAAAAGAAAAATATGAGAGAACTATTGTTTGGGGAAGTTC
AAGTGATCTTTCAATATCATTACTAACTTCTTCCACTTTTTCCAAAATTTGAATATTAACGCTAAAGGTGTAAGA
CTTCAGATTTCAAATTAATCTTTCTATATTTTTAAATTTACAGAATATTATATAACCCACTGCTGAAAAAGAAA
AAAATGATTGTTTTAGAAGTTAAAGTCAATATTGATTTAAATATAAGTAATGAAGGCATATTTCCAATAACTAG
TGATATGGCATCGTTGCAATTTACAGTATCTTCAAAAATACAGAATTTATAGAATAATTTCTCCTCATTTAATAT
TTTTCAAAATCAAAGTTATGGTTTCCTCATTTTACTAAAATCGTATTCTAATTCTTCATTATAGTAAATCTATGA
GCAACTCCTTACTTCGGTTCCTCTGATTTCAAGGCCATATTTTAAAAAATCAAAAGGCACTGTGAACTATTTTGA
AGAAAACACGACATTTTAATACAGATTGAAAGGACCTCTTCTGAAGCTAGAAACAATCTATAGTTATACATCTTC
ATTAATACTGTGTTACCTTTTAAAATAGTAATTTTTACATTTTCCTGTGTAAACCTAATTGTGGTAGAAATTTT
TACCAACTCTATACTCAATCAAGCAAAATTTCTGTATATTCCCTGTGGAATGTACCTATGTGAGTTTCAGAAATT
CTCAAAATACGTGTTCAAAAATTTCTGCTTTTGCATCTTTGGGACACCTCAGAAAACTTATTAACAACTGTGAAT
ATGAGAAATACAGAAGAAATAATAAGCCCTCTATACATAAATGCCCAGCACAATTCATTGTTAAAAAACAACCA
AACCTCACACTACTGTATTTCATTATCTGTACTGAAAGCAAATGCTTTGTGACTATTAAATGTTGCACATCATTC
ATTCACTGTATAGTAATCATTGACTAAAGCCATTTGCTGTGTTTTCTTCTTGTGGXTGXATATATCAGGTAAAAT
ATTTTCCAAAGAGCCATGTGTCATGTAATACTGAACCCTTTGATATTGAGACATTAATTTGGACCCTTGGTATTA
TCTACTAGAATAATGTAATACTGXAGAAATATTGCTCTAATTCTTTCAAAATGGTGCATCCCCCTTAAAAXGTTC
TATTTCCATAAGGATTTAGCTTGCTTATCCCTTCTTATACCCTAAGATGAAGCTGTTTTTGTGCTCTTTGTTCAT
CATTGGCCCTCATTCCAAGCACTTTACGCTGTCTGTAATGGGATCTATTTTGCACTGGAATATCTGAGAATTGC
AAAACTAGACAAAAGTTTCACAACAGATTTCTAAGTTAAATCATTTCATTAAAAGGAAAAAAGAAAAAAAATTT
TGTATGTCAATAACTTTATATGAAGTATTAAAATGCATATTTCTATGTTGTAATATAATGAGTCACAAAATAAAG
CTGTGACAGTTCTGTTAAAAAAAAAAAAAAAAAAAAAAAAAAAAAAAAAAAAAAAAAAAAAAAAAAAAAAAAAAA
AAAAAAAAAAAAAAAA
```

FIGURE 260

```
MACWPQLRLLLWKNLTFRRRQTCQLLLEVAWPLFIFLILISVRLSYPPYEQHECHFPNKAMPSAGTLPWVQGIIC
NANNPCFRYPTPGEAPGVVGNFNKSIVARLFSDARRLLLYSQKDTSMKDMRKVLRTLQQIKKSSSNLKLQDFLVD
NETFSGFLYHNLSLPKSTVDKMLRADVILHKVFLQGYQLHLTSLCNGSKSEEMIQLGDQEVSELCGLPKEKLAAA
ERVLRSNMDILKPILRTLNSTSPFPSKELAEATKTLLHSLGTLAQELFSMRSWSDMRQEVMFLTNVNSSSSSTQI
YQAVSRIVCGHPEGGGLKIKSLNWYEDNNYKALFGGNGTEEDAETFYDNSTTPYCNDLMKNLESSPLSRIIWKAL
KPLLVGKILYTPDTPATRQVMAEVNKTFQELAVFHDLEGMWEELSPKIWTFMENSQEMDLVRMLLDSRDNDHFWE
QQLDGLDWTAQDIVAFLAKHPEDVQSSNGSVYTWREAFNETNQAIRTISRFMECVNLNKLEPIATEVWLINKSME
LLDERKFWAGIVFTGITPGSIELPHHVKYKIRMDIDNVERTNKIKDGYWDPGPRADPFEDMRYVWGGFAYLQDVV
EQAIIRVLTGTEKKTGVYMQQMPYPCYVDDIFLRVMSRSMPLFMTLAWIYSVAVIIKGIVYEKEARLKETMRIMG
LDNSILWFSWFISSLIPLLVSAGLLVVILKLGNLLPYSDPSVVFVFLSVFAVVTILQCFLISTLFSRANLAAACG
GIIYFTLYLPYVLCVAWQDYVGFTLKIFASLLSPVAFGFGCEYFALFEEQGIGVQWDNLFESPVEEDGFNLTTSI
SMMLFDTFLYGVMTWYIEAVFPGQYGIPRPWYFPCTKSYWFGEESDEKSHPGSNQKRMSEICMEEEPTHLKLGVS
IQNLVKVYRDGMKVAVDGLALNFYEGQITSFLGHNGAGKTTTMSILTGLFPPTSGTAYILGKDIRSEMSTIRQNL
GVCPQHNVLFDMLTVEEHIWFYARLKGLSEKHVKAEMEQMALDVGLPSSKLKSKTSQLSGGMQRKLSVALAFVGG
SKVVILDEPTAGVÚPYSRRGIWELLLKYRQGRTIILSTHHMDEADVLGDRIAIISHGKLCCVGSSLFLKNQLGTG
YYLTLVKKDVESSLSSCRNSSSTVSYLKKEDSVSQSSSDAGLGSDHESDTLTIDVSAISNLIRKHVSEARLVEDI
GHELTYVLPYEAAKEGAFVELFHEIDDRLSDLGISSYGISETTLEEIFLKVAEESGVDAETSDGTLPARRNRRAF
GDKQSCLRPFTEDDAADPNDSDIDPESRETDLLSGMDGKGSYQVKGWKLTQQQFVALLWKRLLIARRSRKGFFAQ
IVLPAVFVCIALVFSLIVPPFGKYPSLELQPWMYNEQYTFVSNDAPEDTGTLELLNALTKDPGFGTRCMEGNPIP
DTPCQAGEEEWTTAPVPQTIMDLFQNGNWTMQNPSPACQCSSDKIKKMLPVCPPGAGGLPPPQRKQNTADILQDL
TGRNISDYLVKTYVQIIAKSLKNKIWVNEFRYGGFSLGVSNTQALPPSQEVNDAIKQMKKHLKLAKDSSADRFLN
SLGRFMTGLDTRNNVKVWFNNKGWHAISSFLNVINNAILRANLQKGENPSHYGITAFNHPLNLTKQQLSEVALMT
TSVDVLVSICVIFAMSFVPASFVVFLIQERVSKAKHLQFISGVKPVIYWLSNFVWDMCNYVVPATLVIIIFICFQ
QKSYVSSTNLPVLALLLLLYGWSITPLMYPASFVFKIPSTAYVVLTSVNLFIGINGSVATFVLELFTDNKLNNIN
DILKSVFLIFPHFCLGRGLIDMVKNQAMADALERFGENRFVSPLSWDLVGRNLFAMAVEGVVFFLITVLIQYRFF
IRPRPVNAKLSPLNDEDEDVRRERQRILDGGGQNDILEIKELTKIYRRKRKPAVDRICVGIPPGECFGLLGVNGA
GKSSTFKMLTGDTTVTRGDAFLNKNSILSNIHEVHQNMGYCPQFDAITELLTGREHVEFFALLRGVPEKEVGKVG
EWAIRKLGLVKYGEKYAGNYSGGNKRKLSTAMALIGGPPVVFLDEPTTGMDPKARRFLWNCALSVVKEGRSVVLT
SHSMEECEALCTRMAIMVNGRFRCLGSVQHLKNRFGDGYTIVVRIAGSNPDLKPVQDFFGLAFPGSVLKEKHRNM
LQYQLPSSLSSLARIFSILSQSKKRLHIEDYSVSQTTLDQVFVNFAKDQSDDDHLKDLSLHKNQTVVDVAVLTSF
LQDEKVKESYV
```

FIGURE 261

```
ATTACAGGCATGAGCCACCGCGCCTGGCCCAAACATCAGTTTTGAAAGTAGGGCTACAGTGATTTATATGTATTG
TGGGCACTTATTAATGTAACGATAATAAAACATGAATCGTATAAAGTCCTTTGAGGGAATCTCCTAATGGCTAGG
CTCTCTGTCGTAAGTCATATTCCAGCCCCAGGCTTCTGAGCTCTTATAACATACAACTGAGCATTCTTAAGCTCA
CAACCTATTTCCAGAAAAGAGACCCACATCTTTCTATGTTTTATACTACCTTTGTTTTTACACCATATAGTTTTT
TTCTATTAGTTTAAGGTACCTAGTGTTACAGGTCTAGAAAGTGCAGAGCCATCCCTACCTAGAAGAGAATAGATG
GGAAGAGAACTGAAAGAAAGAATTCCTCAAGCACTGAAGTCAGGAAAATCCCCGTAGGCACTGTATTAGTTGTTC
CATTTATCCCAGCACTCCACTTGTGGATGAAGGAGTTGTATAGAAAGGAGATGAGAAAATGGCAGGAGTGGAAGC
AGCCAAGAAGAGATCGATGACTGAAGATCTCCTTCACCTTCAGGACTGTCTCAAGGGGTTATTTCACCTCTACTC
ATGAGGATGGCCAGTTTTTCTGTCTTTTATCTTTAGACCCATATATAATCAGTTCAGAGCACAAATCAAAATAAA
CTGGCCTAAATAACTGAATTCTAGGAAGCAAAGCTACATCTTTTTTCATATGCCAAAGCTTCTGTTTCCTCATGT
TGTTCCTACTTTTTAAATAATAAATGGCTCTCAGCATCTTAGGAACTAGATGGGTCCCATCTGGGTAGAACCTGC
TATAATTTTTAGAATCACTCTTGTAATTCTTACCTCACTTAAAATATTAGGAAACACAGTAATAGAAAAGACAGG
GAGAACTCGTCTGCAGGTTTTGGCAGTGAAATTTGTCTTCCAGTGAATTGCTATTATTTTCAAATTGCCTATAGT
CAAAAAGCTTTTCCATTGATGGAGACTTACTTTCAAATGAGCTTGTGTTGAATTCAGCACTCTAGATTCTCTCTG
ACATTTTCCTGTCTTTTGGGAAAAAAAAGCAGATATTCCAAAAATGGCAGAAATCTAATTTTTGTAAACTTTTTC
ATCTATAGGATTGAGCCAAAAAACATACATACTATTTAAAGAAAGGTACCATCTAATTCTTTTATTAAAGATAG
CTACTTCTGAAATGTCTTAACAGAGTTTCAAGATTGCAAAGTAGTATTGCATAGCTGGTTTTCTTACATGTGATG
ATGGAGGAGAGAGGAAGACCCAGACTTAGGCATGTAGTGAAATATGTACAGTTTCTGGCATCAGTGTACTATTTA
TAGTCTATAGCATACATTACTTGCAAATGGGAAAAGTATTTTATAATTATTTTTGTACCTCAAAATAATTATTAT
ATTCTACTGTATTATATTCAAATTAAAGTTTATTATTTGATCTTAGATGATATCTGTGAGGTGTGATGAGGGTGG
GACCTAAGTATGTCATGTGCTTTAACCTTTTTTCTAGCCTAAGATGAAGGGAGAA
```

FIGURE 262

YRHEPPRLAQTSVLKVGLQ

FIGURE 263

```
GGCTCTTTTAAATGACCCCAGGCGTCGTGTATTGAATCCTAGACTCACGTCCGTCTCGCCGGCGCCCGAGCCAGT
CCGCGCGCACCGCGTCTGCGTCCCCGAAAGCCCCGCCCGCAAGGGCTGCCCTGCCTACCTGGTCTCCGACGTGCT
CGTCTGGAGGGCGGTGCGAGGGGCCGAGCCGACGAGATGTTCTTGCTGCCTCTTCCGGCTGCGGGGCGAGTAGTC
GTCCGACGTCTGGCCGTAGTACGTTCTGGGAGCCGGAGTCTCTCCACCGCAGACATGACGAAGGGCCTTGTTTTA
GGAATCTATTCCAAAGAAAAAGAAGATGATGTGCCACAGTTCACAAGTGCAGGAGAGAATTTTGATAAATTGTTA
GCTGGAAAGCTGAGAGAGACTTTGAACATATCTGGACCACCTCTGAAGGCAGGGAAGACTCGAACCTTTTATGGT
CTGCATCAGGACTTCCCCAGCGTGGTGCTAGTTGGCCTCGGCAAAAAGGCAGCTGGAATCGACGAACAGGAAAAC
TGGCATGAAGGCAAAGAAAACATCAGAGCTGCTGTTGCAGCGGGGTGCAGGCAGATTCAAGACCTGGAGCTCTCG
TCTGTGGAGGTGGATCCCTGTGGAGACGCTCAGGCTGCTGCGGAGGGAGCGGTGCTTGGTCTCTATGAATACGAT
GACCTAAAGCAAAAAAAGAAGATGGCTGTGTCGGCAAAGCTCTATGGAAGTGGGGATCAGGAGGCCTGGCAGAAA
GGAGTCCTGTTTGCTTCTGGGCAGAACTTGGCACGCCAATTGATGGAGACGCCAGCCAATGAGATGACGCCAACC
AGATTTGCCGAAATTATTGAGAAGAATCTCAAAAGTGCTAGTAGTAAAACCGAGGTCCATATCAGACCCAAGTCT
TGGATTGAGGAACAGGCAATGGGATCATTCCTCAGTGTGGCCAAAGGATCTGACGAGCCCCCAGTCTTCTTGGAA
ATTCACTACAAAGGCAGCCCCAATGCAAACGAACCACCCCTGGTGTTTGTTGGGAAAGGAATTACCTTTGACAGT
GGTGGTATCTCCATCAAGGCTTCTGCAAATATGGACCTCATGAGGGCTGACATGGGAGGAGCTGCAACTATATGC
TCAGCCATCGTGTCTGCTGCAAAGTTAAATTTGCCCATTAATATTATAGGTCTGGCCCTCTTTGTGAAAATATG
CCCAGCGGCAAGGCCAACAAGCCGGGGGATGTTGTTAGAGCCAAAAACGGGAAGACCATCCAGGTTGATAACACT
GATGCTGAGGGGAGGCTCATACTGGCTGATGCGCTCTGTTACGCACACACGTTTAACCCGAAGGTCATCCTCAAT
GCCGCCACCTTAACAGGTGCCATGGATGTAGCTTTGGGATCAGGTGCCACTGGGGTCTTTACCAATTCATCCTGG
CTCTGGAACAAACTCTTCGAGGCCAGCATTGAAACAGGGGACCGTGTCTGGAGGATGCCTCTCTTCGAACATTAT
ACAAGACAGGTTGTAGATTGCCAGCTTGCTGATGTTAACAACATTGGAAAATACAGATCTGCAGGAGCATGTACA
GCTGCAGCATTCCTGAAAGAATTCGTAACTCATCCTAAGTGGGCACATTTAGACATAGCAGGCGTGATGACCAAC
AAAGATGAAGTTCCCTATCTACGGAAAGGCATGACTGGGAGGCCCACAAGGACTCTCATTGAGTTCTTACTTCGT
TTCAGTCAAGACAATGCTTAGTTCAGATACTCAAAAATGTCTTCACTCTGTCTTAAATTGGACAGTTGAACTTAA
AAGGTTTTTGAATAAATGGATGAAAATCTTTTAACGGAGACAAAGGATGGTATTTAAAAATGTAGAACACAATGA
AATTTGTATGCCTTGATTTTTTTTTCATTTCACACAAAGATTTATAAAGGTAAAGTTAATATCTTACTTGATAAG
GATTTTTAAGATACTCTATAAATGATTAAAATTTTTAGAACTTCCTAATCACTTTTCAGAGTATATGTTTTTCAT
TGAGAAGCAAAATTGTAACTCAGATTTGTGATGCTAGGAACATGAGCAAACTGAAAATTACTATGCACTTGTCAG
AAACAATAAATGCAACTTGTTGTGAAAAAAAAAAAAAAAAAAAAAA
```

FIGURE 264

MFLLPLPAAGRVVVRRLAVVRSGSRSLSTADMTKGLVLGIYSKEKEDDVPQFTSAGENFDKLLAGKLRETLNISG
PPLKAGKTRTFYGLHQDFPSVVLVGLGKKAAGIDEQENWHEGKENIRAAVAAGCRQIQDLELSSVEVDPCGDAQA
AAEGAVLGLYEYDDLKQKKKMAVSAKLYGSGDQEAWQKGVLFASGQNLARQLMETPANEMTPTRFAEIIEKNLKS
ASSKTEVHIRPKSWIEEQAMGSFLSVAKGSDEPPVFLEIHYKGSPNANEPPLVFVGKGITFDSGGISIKASANMD
LMRADMGGAATICSAIVSAAKLNLPINIIGLAPLCENMPSGKANKPGDVVRAKNGKTIQVDNTDAEGRLILADAL
CYAHTFNPKVILNAATLTGAMDVALGSGATGVFTNSSWLWNKLFEASIETGDRVWRMPLFEHYTRQVVDCQLADV
NNIGKYRSAGACTAAAFLKEFVTHPKWAHLDIAGVMTNKDEVPYLRKGMTGRPTRTLIEFLLRFSQDNA

FIGURE 265

ATGAAGAGGCGGCGGCGCCGGCGCCCGGTCGCCCCGGCCACGGCCGCCCGGGGCGGCGACTTTAGGGCAGAAGAC
GGGGCTGGGTTGGAGGCGCGGGAGGAGAAGGTGGTGTACTCGCGGTCGCAACTGTCGCTGGCTGACAGCACCAAG
GCGCTGGGCGACGCCTTCAAGCTCTTCATGCCCCGCAGCACGGAGTTCATGAGCTCGGACGCGGAGCTCTGGAGC
TTCCTCTGCAGCCTCAAGCACCAGTTCTCCCCGCACATCCTGCGCAGCAAGGACGTCTACGGCTACTCCTCCTGC
CGGGCCCTGGTACCCGACCCCCGGGGCCCCCTACAGCCCGCGGCCAGGCGCGCCGGCCGGTTCCGCGCGCAGCG
GCCAGGAGGAGGCGCCGCGGAGCCCGGGCGGCCGCTGCCCGCAGGAGGAAGCCCCGGCCGCCACCCCCACCGCCG
CCGCCCCCGAGGAGAGCTGCCCGGCCAAGCCCGTGGCCCCCGGGCCCTGCTTCGGGGGCCGCACCTTGGAGGAG
ATCTGGAGGCGGCCACCCCGACGCTGACCACCTTCCCCACCATCCGCGTCGGCAGCGACGTGTGGGGCGAGCGC
AGCCTGGCGGCAGCGCGGCGCAGGGCGCGCCAGGTCCTGCGAGTGAACCTGGAACCCATGGTGAGGCTCCGCCGC
TTCCCGGTGCCCCGGGCATGAGGTGCGGCCTCCAGGGCGCCTCCTGCCGGCCCCGACCTTGGGACAGGCCTTCCG
CCCGGAGGAATGAACAAGTGTCAGTCGAGTGTTTACAGATCCGGCCAGGACCCCGGCCCCCAATGCACTTTACGC
GCGAAGAAGTTGCCGGATGGTTGTCCCTGTCCCGGGCCGCGGCGCGGTCGTCTTGGACGCTGGGGCAGGTGTGCC
CTCTGCTGCCTCCCGTACCCGGCCTGCGGAGGGAGGGGACAGCTGGACCCGCAGGGGAGGTCCCTTTCTTCCTGA
CCACCGATTGAGACGTCTCCAGGACCTTAGGGGCAGATCCGTTTTCTCACTGTTGGACTCTACCTCACTGGTCTG
GAAGTCCTCCGAAGACATTATTTTTCCAAAGGAATTTGGTTTCGTGCTTGTGTAATAAAGCCAGAATTTACTTGT
TCTTTATCTCCCCCTTTTTCTATTTCACTGTCACCCCTCTTTGTGGACAGAAGTTCGAACATGTGGTGTTGCACT
AGTTTGTGCTCAGGGTATTCTGAAGCCCACTCGTTTCCTAATTTTTACTGGATTCCAAAGCTTTGATCGAGGATA
TTTTTAAGAGGTTCAAGCTTGTGACTGTTAGTAGTGCAAGGATTTGTATGGGCTCAGTGATTACAAACAAAGAC
ATGCAAAATACAACTGTTTAAACATTTTCAAGGTATTTTTAAAGGTTTTGTATTGAAACAATGTTTATATTTACT
GAGCTCCTAAAAATGGTAGAATACACATGAAAACTTTTGTTTAGGAAAAGTTAACTTGTTAAATTCTTTTGAATT
GAATAAAAAAATGCATTGAAACC

FIGURE 266

MKRRRRRRPVAPATAARGGDFRAEDGAGLEAREEKVVYSRSQLSLADSTKALGDAFKLFMPRSTEFMSSDAELWS
FLCSLKHQFSPHILRSKDVYGYSSCRALVPDPPGPPTARGQARRPVPRAAARRRRGARAAAARRRKPRPPPPPP
PPPEESCPAKPVAPGPCFGGRTLEEIWRAATPTLTTFPTIRVGSDVWGERSLAAARRRARQVLRVNLEPMVRLRR
FPVPRA

FIGURE 267

ATGTGGTTCTTGACAACTCTGCTCCTTTGGGTTCCAGTTGATGGGCAAGTGGACACCACAAAGGCAGTGATCACT
TTGCAGCCTCCATGGGTCAGCGTGTTCCAAGAGGAAACCGTAACCTTGCACTGTGAGGTGCTCCATCTGCCTGGG
AGCAGCTCTACACAGTGGTTTCTCAATGGCACAGCCACTCAGACCTCGACCCCCAGCTACAGAATCACCTCTGCC
AGTGTCAATGACAGTGGTGAATACAGGTGCCAGAGAGGTCTCTCAGGGCGAAGTGACCCCATACAGCTGGAAATC
CACAGAGGCTGGCTACTACTGCAGGTCTCCAGCAGAGTCTTCACGGAAGGAGAACCTCTGGCCTTGAGGTGTCAT
GCGTGGAAGGATAAGCTGGTGTACAATGTGCTTTACTATCGAAATGGCAAAGCCTTTAAGTTTTTCCACTGGAAT
TCTAACCTCACCATTCTGAAAACCAACATAAGTCACAATGGCACCTACCATTGCTCAGGCATGGGAAAGCATCGC
TACACATCAGCAGGAATATCTGTCACTGTGAAAGAGCTATTTCCAGCTCCAGTGCTGAATGCATCTGTGACATCC
CCACTCCTGGAGGGGAATCTGGTCACCCTGAGCTGTGAAACAAAGTTGCTCTTGCAGAGGCCTGGTTTGCAGCTT
TACTTCTCCTTCTACATGGGCAGCAAGACCCTGCGAGGCAGGAACACATCCTCTGAATACCAAATACTAACTGCT
AGAAGAGAAGACTCTGGGTTATACTGGTGCGAGGCTGCCACAGAGGATGGAAATGTCCTTAAGCGCAGCCCTGAG
TTGGAGCTTCAAGTGCTTGGCCTCCAGTTACCAACTCCTGTCTGGTTTCATGTCCTTTTCTATCTGGCAGTGGGA
ATAATGTTTTAGTGAACACTGTTCTCTGGGTGACAATACGTAAAGAACTGAAAAGAAAGAAAAAGTGGGATTTA
GAAATCTCTTTGGATTCTGGTCATGAGAAGAAGGTAATTTCCAGCCTTCAAGAAGACAGACATTTAGAAGAAGAG
CTGAAATGTCAGGAACAAAAAGAAGAACAGCTGCAGGAAGGGGTGCACCGGAAGGAGCCCCAGGGGGCCACGTAG
CAG

FIGURE 268

MWFLTTLLLWVPVDGQVDTTKAVITLQPPWVSVFQEETVTLHCEVLHLPGSSSTQWFLNGTATQTSTPSYRITSA
SVNDSGEYRCQRGLSGRSDPIQLEIHRGWLLLQVSSRVFTEGEPLALRCHAWKDKLVYNVLYYRNGKAFKFFHWN
SNLTILKTNISHNGTYHCSGMGKHRYTSAGISVTVKELFPAPVLNASVTSPLLEGNLVTLSCETKLLLQRPGLQL
YFSFYMGSKTLRGRNTSSEYQILTARREDSGLYWCEAATEDGNVLKRSPELELQVLGLQLPTPVWFHVLFYLAVG
IMFLVNTVLWVTIRKELKRKKKWDLEISLDSGHEKKVISSLQEDRHLEEELKCQEQKEEQLQEGVHRKEPQGAT

FIGURE 269

```
TTTCATTTCCTCACTGACTATAAAAGAATAGAGAAGGAAGGGCTTCAGTGACCGGCTGCCTGGCTGACTTACAGC
AGTCAGACTCTGACAGGATCATGGCTATGATGGAGGTCCAGGGGGGACCCAGCCTGGGACAGACCTGCGTGCTGA
TCGTGATCTTCACAGTGCTCCTGCAGTCTCTCTGTGTGGCTGTAACTTACGTGTACTTTACCAACGAGCTGAAGC
AGATGCAGGACAAGTACTCCAAAAGTGGCATTGCTTGTTTCTTAAAAGAAGATGACAGTTATTGGGACCCCAATG
ACGAAGAGAGTATGAACAGCCCCTGCTGGCAAGTCAAGTGGCAACTCCGTCAGCTCGTTAGAAAGATGATTTTGA
GAACCTCTGAGGAAACCATTTCTACAGTTCAAGAAAAGCAACAAAATATTTCTCCCCTAGTGAGAGAAAGAGGTC
CTCAGAGAGTAGCAGCTCACATAACTGGGACCAGAGGAAGAAGCAACACATTGTCTTCTCCAAACTCCAAGAATG
AAAAGGCTCTGGGCCGCAAAATAAACTCCTGGGAATCATCAAGGAGTGGGCATTCATTCCTGAGCAACTTGCACT
TGAGGAATGGTGAACTGGTCATCCATGAAAAGGGTTTTACTACATCTATTCCCAAACATACTTTCGATTTCAGG
AGGAAATAAAAGAAAACACAAAGAACGACAAACAAATGGTCCAATATATTTACAAATACACAAGTTATCCTGACC
CTATATTGTTGATGAAAAGTGCTAGAAATAGTTGTTGGTCTAAAGATGCAGAATATGGACTCTATTCCATCTATC
AAGGGGGAATATTTGAGCTTAAGGAAAATGACAGAATTTTTGTTTCTGTAACAAATGAGCACTTGATAGACATGG
ACCATGAAGCCAGTTTTTTCGGGGCCTTTTTAGTTGGCTAACTGACCTGGAAAGAAAAAGCAATAACCTCAAAGT
GACTATTCAGTTTTCAGGATGATACACTATGAAGATGTTTCAAAAAATCTGACCAAAACAAACAAACAGAAAACA
GAAAACAAAAAAACCTCTATGCAATCTGAGTAGAGCAGCCACAACCAAAAAATTCTACAACACACACTGTTCTGA
AAGTGACTCACTTATCCCAAGAGAATGAAATTGCTGAAAGATCTTTCAGGACTCTACCTCATATCAGTTTGCTAG
CAGAAATCTAGAAGACTGTCAGCTTCCAAACATTAATGCAATGGTTAACATCTTCTGTCTTTATAATCTACTCCT
TGTAAAGACTGTAGAAGAAAGAGCAACAATCCATCTCTCAAGTAGTGTATCACAGTAGTAGCCTCCAGGTTTCCT
TAAGGGACAACATCCTTAAGTCAAAAGAGAGAAGAGGCACCACTAAAAGATCGCAGTTTGCCTGGTGCAGTGGCT
CACACCTGTAATCCCAACATTTTGGGAACCCAAGGTGGGTAGATCACGAGATCAAGAGATCAAGACCATAGTGAC
CAACATAGTGAAACCCCATCTCTACTGAAAGTACAAAAATTAGCTGGGTGTGTTGGCACATGCCTGTAGTCCCAG
CTACTTGAGAGGCTGAGGCAAGAGAATTGTTTGAACCCGGGAGGCAGAGGTTGCAGTGTGGTGAGATCATGCCAC
TACACTCCAGCCTGGCGACAGAGCGAGACTTGGTTTCAAAAAAAAAAAAAAAAAAAACTTCAGTAAGTACGTGTT
ATTTTTTTCAATAAAATTCTATTACAGTATGTCAAAAAAAAAAAAAAAAAA
```

FIGURE 270

MAMMEVQGGPSLGQTCVLIVIFTVLLQSLCVAVTYVYFTNELKQMQDKYSKSGIACFLKEDDSYWDPNDEESMNS
PCWQVKWQLRQLVRKMILRTSEETISTVQEKQQNISPLVRERGPQRVAAHITGTRGRSNTLSSPNSKNEKALGRK
INSWESSRSGHSFLSNLHLRNGELVIHEKGFYYIYSQTYFRFQEEIKENTKNDKQMVQYIYKYTSYPDPILLMKS
ARNSCWSKDAEYGLYSIYQGGIFELKENDRIFVSVTNEHLIDMDHEASFFGAFLVG

FIGURE 271

```
GCAAGAGAGCGGGAAGCCGAGCTGGGCGAGAAGTAGGGGAGGGCGGTGCTCCGCCGCGGTGGCGGTTGCTATCGC
TTCGCAGAACCTACTCAGGCAGCCAGCTGAGAAGAGTTGAGGGAAAGTGCTGCTGCTGGGTCTGCAGACGCGATG

GATAACGTGCAGCCGAAAATAAAACATCGCCCCTTCTGCTTCAGTGTGAAAGGCCACGTGAAGATGCTGCGGCTG
GCACTAACTGTGACATCTATGACCTTTTTTATCATCGCACAAGCCCCTGAACCATATATTGTTATCACTGGATTT
GAAGTCACCGTTATCTTATTTTTCATACTTTTATATGTACTCAGACTTGATCGATTAATGAAGTGGTTATTTTGG
CCTTTGCTTGATATTATCAACTCACTGGTAACAACAGTATTCATGCTCATCGTATCTGTGTTGGCACTGATACCA
GAAACCACAACATTGACAGTTGGTGGAGGGGTGTTTGCACTTGTGACAGCAGTATGCTGTCTTGCCGACGGGGCC
CTTATTTACCGGAAGCTTCTGTTCAATCCCAGCGGTCCTTACCAGAAAAAGCCTGTGCATGAAAAAAAAGAAGTT
TTGTAATTTTATATTACTTTTTAGTTTGATACTAAGTATTAAACATATTTCTGTATTCTTCCAAAAAAAAAAAAA
AAAAAAAAAAAAA
```

FIGURE 272

MDNVQPKIKHRPFCFSVKGHVKMLRLALTVTSMTFFIIAQAPEPYIVITGFEVTVILFFILLYVLRLDRLMKWLF
WPLLDIINSLVTTVFMLIVSVLALIPETTTLTVGGGVFALVTAVCCLADGALIYRKLLFNPSGPYQKKPVHEKKE
VL

FIGURE 273

```
GCCCCTTTCTTTCTCCTCGTCGGCCCGAGAGCAGGAACACGATAACGAAGGAGGCCCAACTTCATTCAATAAGGA
GCCTGACGGATTTATCCCAGACGGTAGAACAAAAGGAAGAATATTGATGGATTTTAAACCAGAGTTTTTAAAGAG
CTTGAGAATACGGGGAAATTAATTTGTTCTCCTACACACATAGATAGGGTAAGGTTGTTTCTGATGCAGCTGAGA
AAAATGCAGACCGTCAAAAAGGAGCAGGCGTCTCTTGATGCCAGTAGCAATGTGGACAAGATGATGGTCCTTAAT
TCTGCTTTAACGGAAGTGTCAGAAGACTCCACAACAGGTGAGGACGTGCTTCTCAGTGAAGGAAGTGTGGGGAAG
AACAAATCTTCTGCATGTCGGAGGAAACGGGAATTCATTCCTGATGAAAAGAAAGATGCTATGTATTGGGAAAAA
AGGCGGAAAAATAATGAAGCTGCCAAAAGATCTCGTGAGAAGCGTCGACTGAATGACCTGGTTTTAGAGAACAAA
CTAATTGCACTGGGAGAAGAAAACGCCACTTTAAAAGCTGAGCTGCTTTCACTAAAATTAAAGTTTGGTTTAATT
AGCTCCACAGCATATGCTCAAGAGATTCAGAAACTCAGTAATTCTACAGCTGTGTACTTTCAAGATTACCAGACT
TCCAAATCCAATGTGAGTTCATTTGTGGACGAGCACGAACCCTCGATGGTGTCAAGTAGTTGTATTTCTGTCATT
AAACACTCTCCACAAAGCTCGCTGTCCGATGTTCAGAAGTGTCCTCAGTAGAACACACGCAGGAGAGCTCTGTG
CAGGGAAGCTGCAGAAGTCCTGAAAACAAGTTCCAGATTATCAAGCAAGAGCCGATGGAATTAGAGAGCTACACA
AGGGAGCCAAGAGATGACCGAGGCTCTTACACAGCGTCCATCTATCAAAACTATATGGGGAATTCTTTCTCTGGG
TACTCACACTCTCCCCACTACTGCAAGTCAACCGATCCTCCAGCAACTCCCCGGGAACGTCGGAAACTGATGAT
GGTGTGGTAGGAAAGTCATCTGATGGAGAAGACGAGCAACAGGTCCCCAAGGGCCCCATCCATTCTCCAGTTGAA
CTCAAGCATGTGCATGCAACTGTGGTTAAAGTTCCAGAAGTGAATTCCTCTGCCTTGCCACACAAGCTCCGGATC
AAAGCCAAAGCCATGCAGATCAAAGTAGAAGCCTTTGATAATGAATTTGAGGCCACGCAAAAACTTTCCTCACCT
ATTGACATGACATCTAAAAGACATTTCGAACTCGAAAAGCATAGTGCCCCAAGTATGGTACATTCTTCTCTTACT
CCTTTCTCAGTGCAAGTGACTAACATTCAAGATTGGTCTCTCAAATCGGAGCACTGGCATCAAAAAGAACTGAGT
GGCAAAACTCAGAATAGTTTCAAAACTGGAGTTGTTGAAATGAAAGACAGTGGCTACAAAGTTTCTGACCCAGAG
AACTTGTATTTGAAGCAGGGGATAGCAAACTTATCTGCAGAGGTTGTCTCACTCAAGAGACTTATAGCCACACAA
CCAATCTCTGCTTCAGACTCTGGGTAAATTACTACTGAGTAAGAGCTGGGCATTTAGAAAGATGTCATTTGCAAT
AGAGCAGTCCATTTTGTATTATGCTGAATTTTCACTGGACCTGTGATGTCATTTCACTGTGATGTGCACATGTTG
TCTGTTTGGTGTCTTTTTGTGCACAGATTATGATGAAGATTAGATTGTGTTATCACTCTGCCTGTGTATAGTCAG
ATAGTCCATGCGAAGGCTGTATATATTGAACATTATTTTTGTTGTTCTATTATAAAGTGTGTAAGTTACCAGTTT
CAATAAAGGATTGGTGACAAACACAGAAAAAAAAAAAAAAAAAAAAA
```

FIGURE 274

MQLRKMQTVKKEQASLDASSNVDKMMVLNSALTEVSEDSTTGEDVLLSEGSVGKNKSSACRRKREFIPDEKKDAM
YWEKRRKNNEAAKRSREKRRLNDLVLENKLIALGEENATLKAELLSLKLKFGLISSTAYAQEIQKLSNSTAVYFQ
DYQTSKSNVSSFVDEHEPSMVSSSCISVIKHSPQSSLSDVSEVSSVEHTQESSVQGSCRSPENKFQIIKQEPMEL
ESYTREPRDDRGSYTASIYQNYMGNSFSGYSHSPPLLQVNRSSSNSPGTSETDDGVVGKSSDGEDEQQVPKGPIH
SPVELKHVHATVVKVPEVNSSALPHKLRIKAKAMQIKVEAFDNEFEATQKLSSPIDMTSKRHFELEKHSAPSMVH
SSLTPFSVQVTNIQDWSLKSEHWHQKELSGKTQNSFKTGVVEMKDSGYKVSDPENLYLKQGIANLSAEVVSLKRL
IATQPISASDSG

FIGURE 275A

```
GGCCCTCCCGACGCGCAGAGCCATGGCCTCCCACCTGCGCCCGCCGTCCCCGCTCCTCGTGCGGGTGTACAAGTC
CGGCCCCCGAGTACGAAGGAAGCTGGAGAGCTACTTCCAGAGCTCTAAGTCCTCGGGCGGCGGGGAGTGCACGGT
CAGCACCCAGGAACACGAAGCCCCGGGCACCTTCCGGGTGGAGTTCAGTGAAAGGGCAGCTAAGGAGAGAGTGTT
GAAAAAGGAGAGCACCAAATACTTGTTGACGAAAAACCTGTGCCCATTTTCCTGGTACCCACTGAAAATTCAAT
AAAGAAGAACACGAGACCTCAAATTTCTTCACTGACACAATCACAAGCAGAAACACCGTCTGGTGATATGCATCA
ACATGAAGGACATATTCCTAATGCTGTGGATTCCTGTCTCCAAAAGATCTTTCTTACTGTAACAGCTGACCTGAA
CTGTAACCTGTTCTCCAAAGAGCAGAGGGCATACATAACCACACTGTGCCCTAGTATCAGAAAAATGGAAGGTCA
CGATGGAATTGAGAAGGTGTGGTGACTTCCAAGACATTGAAAGAATACATCAATTTTGAGTGAGCAGTTCCT
GGAAAGTGAGCAGAAACAACAATTTTCCCCTTCAATGACAGAGAGGAAGCCACTCAGTCAGCAGGAGAGGGACAG
CTGCATTTCTCCTTCTGAACCAGAAACCAAGGCAGAACAAAAAAGCAACTATTTTGAAGTTCCCTTGCCTTACTT
TGAATACTTTAAATATATCTGTCCTGATAAAATCAACTCAATAGAGAAAAGATTTGGTGTAAACATTGAAATCCA
GGAGAGTTCTCCAAATATGGTCTGTTTAGATTTCACCTCAAGTCGATCAGGTGACCTGGAAGCAGCTCGTGAGTC
TTTTGCTAGTGAATTTCAGAAGAACACAGAACCTCTGAAGCAAGAATGTGTCTCTTTAGCAGACAGTAAGCAGGC
AAATAAATTCAAACAGGAATTGAATCACCAGTTTACAAAGCTCCTTATAAAGGAGAAAGGAGGCGAATAACTCT
CCTTGGGACCCAAGATGACATTTCAGCTGCCAAACAAAAAATCTCTGAAGCTTTGTCAAGATACCTGTGAAACT
ATTTGCTGCCAATTACATGATGAATGTAATTGAGGTTGATAGTGCCCACTATAAACTTTTAGAAACTGAATTACT
ACAGGAGATATCAGAGATCGAAAAAAGGTATGACATTTGCAGCAAGGTTTCTGAGAAAGGTCAGAAAACCTGCAT
TCTGTTTGAATCCAAGGACAGGCAGGTAGATCTATCTGTGCATGCTTATGCAAGTTTCATCGATGCCTTTCAACA
TGCCTCATGTCAGTTGATGAGAGAAGTTCTTTTACTGAAGTCTTTGGGCAAGGAGAGAAAGCACTTACATCAGAC
CAAGTTTGCTGATGACTTTAGAAAAAGACATCCAAATGTACACTTTGTGCTAAATCAAGAGTCAATGACTTTGAC
TGGTTTGCCAAATCACCTTGCAAAGGCGAAGCAGTATGTTCTAAAAGGAGGAGGAATGTCTTCATTGGCTGGAAA
GAAATTGAAAGAGGGTCATGAAACACCGATGGACATTGATAGCGATGATTCCAAAGCAGCTTCTCCGCCACTCAA
GGGCTCTGTGAGTTCTGAGGCCTCAGAACTGGACAAGAAGGAAAAGGGCATCTGTGTCATCTGTATGGACACCAT
TAGTAACAAAAAAGTGCTACCAAAGTGCAAGCATGAATTCTGCGCCCCTTGTATCAACAAAGCCATGTCATATAA
GCCAATCTGTCCCACATGCCAGACTTCCTATGGTATTCAGAAAGGAAATCAGCCAGAGGGAAGCATGGTTTTCAC
TGTTTCAAGAGACTCACTTCCAGGTTATGAGTCCTTTGGCACCATTGTGATTACTTATTCTATGAAAGCAGGCAT
ACAAACAGAAGAACACCCAAACCCAGGAAAGAGATACCCTGGAATACAGCGAACTGCATACTTGCCTGATAATAA
GGAAGGAAGGAAGGTTTTGAAACTGCTTTATAGGGCCTTTGACCAAAAGCTGATTTTTACAGTGGGGTACTCTCG
CGTATTAGGAGTCTCAGATGTCATCACTTGGAATGATATTCACCACAAAACATCCCGGTTTGGAGGACCAGAAAT
GTATGGCTATCCTGATCCTTCTTACCTGAAACGTGTCAAAGAGGAGCTGAAAGCTAAAGGAATTGAGTAAGACAA
CTGCTGGAAGATGTCTTAAATCAAGCTTTCAAAAAAATATATTTTAGGAGGCTGATTTAATGCCAGTCTAAATCC
TTATGTAGAAAGGACTTTGAAATTTTTCTTCTCAAGAAATGGTTTGTATAAGAATAACAATCTGCTAGTCTATCA
TTTCTGGAGTGATACTTTTTTTTTGAGACGGAGTCTGCTCTGTCGCTCGCGCTGGAGTGCAGTGGCATGATCTC
GGCTCACTGCAAGCTCCGCCTCCCAGGTTCATGCCATTCTCCTACCTCAGCCTCCCGAGTAGCTGGGACTACAGG
CGCCCACCACCATGCCCGGCTAATTTTTGTTTTTGTATTTTTAGTAGAGACAGGGTTTCACTGTGTTAGCCAGGA
TGGTCTCGATCTCCTGACCTCGTGATCCGCCCGCCTCGGCCTTCAAAGTGTTGGGATTATAGGCGTGAGCCACC
GCGCCCAGCCCTGGAGTGATACTTTTTATGGAAGACAAAAGCCCCCCAAATCTGTGTAAAATCTGCTGCAAAGGT
GTCATCCCTCTTGTGTCATCACTGGGGTTAGAGGTGGGTCCGAAATAATCTTCTGTGTCCTTCAGTTGGACTCTC
GGCTGCCAATTGATCTCTTTTCATTGCCATCTCTGGGGTGGTTCTTTGGTTTTTGTGTGTTTTCCCCTTCATC
TCTACCTGTGAAAGTGAAATTCTATTGTAAATGGGAGGAAAAAGGGTTGGTTGTGAAAAATTAAAGACCCACATT
CTGCTTTCTTACTCATGGTAAGAAAAGTGGCCATGAGTAGAGATTGGGCAAGCATTGGTAATAAATGGAATAAGA
CTATTATTATTATTTGAGATGGAGTCTCACTCTGTCACCCAGGCTGGAATGCAGTGGTGTGATCTTGGCTCA
CTGCAACCTCCACTTCCCGGGTTCAAGCGATTCTCCTGCCTCAGCCTCCTGAGTAGCTGGGATTACAGGTGTGTG
CCTCCACACCCGGCTAATTTTTGTATTTTTAGTAGAGACGGGGTTTTGCCATGTTGGCCAGGCTGGTTTCAAAC
TCCTGAGCTCAAATGATCCTCCTGCCTTGGCCTCCCAAAGTGCTGGAATTACAGGCATGAGCCACCACACCCACA
CAAGACTATCATTTTAATGACCAAGAGCCTAGTATATAGTTGGTGCCTGTCTTAGTCTGTTTGTGTTGCTATAA
AAGAACACCTGAGACTGGGTAATTGATAAAGAAAAAGGTTTGTTTGGCTCACAATTTTGCTGGCTAGAAGGTTGG
GCATCCGGTGAAAGCCTCAGGCTGCTTCCATTCATAGCAAAGGGCAGCCAGTGTGTGCAGAAATCAAATGACAGA
```

FIGURE 275B

```
GAGGAAGTGAGAGAGAGAGGTGTCGGGGAGGTGCCAGGCTCTTTTTAACAAGCAGTTCTTCAGGAACTAAGAGTG
AGTCACTCCCATGAGAACAGCACCAAGCCATTCATGGGGGAATCTGCCCCCATGACCCAGACCCCTCCCGTTAGG
CTTCACCTCCAACACTGAGGATCAAATTTCAACATGAGATTTGGAGGAGGTCAAACAAACTAAACTGTAGCAGTG
TTTCATAAAATTGGTTGCCTGACTCAGGTTGCTAGTAAGCCAGCAGAGGGATATTTGCCTCCTAAATCTTTGGCA
GAGGCAGGAGTAAGGAAGCCATTTCTGGAGTCCTTGCTACTAATTTGGAAAACTGAGCTTCTTTCTTTCATTGCT
TTTTCCCTTAAGAGACAAGTCCTTACTATATTGCCCTGTCTCTCAAGGGAAGACATCAAGACTGGACTTGAACTC
CTGGGCTCAAGCCATCCCCCAACCTTGGCCTCTCGAGTAGATGGGATTATAGGCATGTGCCACGGTGCCTGACTT
GAGTTTCTTATTCTAGAACACTTGGAGCCTGAACTCTGACCAGGCCCCTCACTTGAGCCTTTGCTTTCTGCTCCT
TGTAAACTGCCATATTGGGTGCACTTGCCCTGCCACAGTAATGCTATATATTTCTGAGCATTGTTTTTCTCTAGA
TAATTTTATATTTTTGAGTATACCCCACTTCCAAGTGTTTTTTGTTTTGTTTTGCTTTGTTTTTGTTGTTGTTGT
TTTGAGACAGGGTCTCACTGTGTCCCCCAGGCTGGAGTGCAGTGGCACAATGACGACTCACTGCAGCCTCAACCT
CTGGGGCCAAGTGATCCTCCCACCTCAGCCTCTCAAGTGGCTGGGACCACAGAAGTGCACCACCATGCCTGGCTT
TTTTTTTTTTTTTTTGGTCGAGATGGGGTGTCCCTGTGTTGCCCAGACTGGTCTTGAACTCCTGGACTCAAGGG
ATCCTCCTGTCTTGGGCTCCCAAAGTGTTGGGATTACAGGCGTGAGTGACCATGCCTAGCTCACTTCCAGGTTTA
ACAGACAAAATAAACTTACTCTAGTTTCCATCTCTATCATTTTATAATAACCGTAGCCCACATTGTAGTAGTTTT
TCAGCTCTTTACTAAGTCCCACCAATTCATGTTTTCACCCTTAAAATCTTTCTCACTGATACTCTCTGGACAG
AAAAAAGGTGAAATAAGCCTACTATAAGGAATATATGACATGCTAAATTTTATTTTAAACGGTTCTTCAAGTCA
GATTAAAGTAATAATAGCAAATTATGTGATTATCCATGTCCCAGCCTCTCTCCAAAAAAATAGTAAACAAGATGT
CTTCTTCTTTTCCCAAAGATACACATACACACATGTACAAATTTTTTTATCAGATAATAATAGCTAATATTTAAT
GAGTACTTACCTTAGTTTGTCCCCTTTACAACAGCTTTACATCTGTGTGATTGATACAGTTCATATTCCCATTTT
ATAACTGAGAAAACTGGTGCACAGAGAGGATAAGCAACTTGCCAAAGGTCACACAGTTAATAAGTGGAAATGCTG
GGGTATGAACCAGGTAGTCTGCCCCCATAGCTCTGCCCCCCAGAGCTGTACTGTCTCCCATGAGGGTACTTCTCC
ATGGAGCAGCCTGAGGCGATCCCTTTATTCTGGGCTTCTCTCAGAAATGGATTCCCACACAGTATTCAAAGCAAA
TTCCCCAGAGGAAATCCTATTGGAAGAACTTAAAAACTCAGAATCTTTTCTTTGTCCAGAGAGTTGAGGAAGC
TTAAGCTAAATGATACATGTTTTTAAAAAAAATCAGATTATAAATTTAGTTTTGGTGATTCATTAAATTCTTT
ACTATTATAGTTATTTTCTAGCTGTTCATCTTTTAGCTAAATTTGTTCCAAAGAAGCAAAAGTTTGGTTTCTACT
AAGTTCTGGATTCTGGATGGGAGATTGCACTGTGTGTGACATGCAAGTTTCATGGTGTGGGAGATTGCAGAGCAT
TTGGGTTACTGCTTTTACTCTTTGGAAGCTGTTATCATCTGTATCTGCTTTAAATAAAGTTAAAGATTTGGAACA
AAAAAAAAAAAAAAAAAA
```

FIGURE 276

ALPTRRAMASHLRPPSPLLVRVYKSGPRVRRKLESYFQSSKSSGGGECTVSTQEHEAPGTFRVEFSERAAKERVL
KKGEHQILVDEKPVPIFLVPTENSIKKNTRPQISSLTQSQAETPSGDMHQHEGHIPNAVDSCLQKIFLTVTADLN
CNLFSKEQRAYITTLCPSIRKMEGHDGIEKVCGDFQDIERIHQFLSEQFLESEQKQQFSPSMTERKPLSQQERDS
CISPSEPETKAEQKSNYFEVPLPYFEYFKYICPDKINSIEKRFGVNIEIQESSPNMVCLDFTSSRSGDLEAARES
FASEFQKNTEPLKQECVSLADSKQANKFKQELNHQFTKLLIKEKGGELTLLGTQDDISAAKQKISEAFVKIPVKL
FAANYMMNVIEVDSAHYKLLETELLQEISEIEKRYDICSKVSEKGQKTCILFESKDRQVDLSVHAYASFIDAFQH
ASCQLMREVLLLKSLGKERKHLHQTKFADDFRKRHPNVHFVLNQESMTLTGLPNHLAKAKQYVLKGGGMSSLAGK
KLKEGHETPMDIDSDDSKAASPPLKGSVSSEASELDKKEKGICVICMDTISNKKVLPKCKHEFCAPCINKAMSYK
PICPTCQTSYGIQKGNQPEGSMVFTVSRDSLPGYESFGTIVITYSMKAGIQTEEHPNPGKRYPGIQRTAYLPDNK
EGRKVLKLLYRAFDQKLIFTVGYSRVLGVSDVITWNDIHHKTSRFGGPEMYGYPDPSYLKRVKEELKAKGIE

FIGURE 277

```
CAAAAAGAAAAAAAAACAAGGTTAAAAGAGAAAGGGAGTAACTGCAAAATGGCAGAGCTGTCTGATCCCAAATGA
CACTTGTTCTCTCTGCTGCTGGGCACCTTCACGCTTTCCTATGGGTGTCACCCACCTCCCACCCTGAGGTATTCC
ACCTCCTACCTGGATGCGAGCAGCAGTTTCCCTGCGGGAAATCCTCCTTCAGGGCAGCTTCACGGCGGCTCACTA
GCCCCTCCAGCAGCGCCAGGGTGTCCTCGTGGCTCAGGCCACCACCACCTCCCTGGCCAGGAGCCCCTTGCCGCA
GCTCCAGACGTTCCAGCCGCATGGCCTCCTTCTGCCAGTTGGAGGAAAATTCAGCAGCAAGAGCTTCCAGACGCC
GCTCCAGAGAGTGTACCCGGGACATAACACGCTGCTCAGCCTGGAAGGGCAGAGAGAGAGCCACGGAGTGAGGGA
CCCTTGGATGATAGTGCTTCCCAAAGACCACCCGACACAGCCAACACAGAAAGAAAGGGAAAAGATTCCAGAGA
CGTTCCAGCATAAGGCCATGCAGGGCCGGCTGGAGCTCGTGGGCAGGGGCTGCCGACCTCTGAGCTGGGTGTGCT
GGGAGCCAGGGATCACTGGGTGCCGGCCACAGAGGAAGGTCCCTGAGGACACAGTACCGAAGTCTGATCCCAGAG
GAGGAAGGAAGGTGGGCCGGGGAGAAGGTCTGAGTGCAGGGATGGTCCAGGAGGAGGACTGGAAGCTGCAGGATG
GCTGCAGGGGGCCGTGGACCCTCCTGGCCTGAAGCTCACTCCTTCCCCGCCTCCTACAGGGGCAGGGGAGCCAGG
GCTGCGAGTTCTGTCTGTGGACTCTCAATGGCTTTCACTCCTTCCCTAGGTAACTATGGCTAAGAGACAGAATAA
TTTGAAAATACGTTCTTTTTCCTCTTTAGCTGGATGTCCCACAGAGAAAATGGAATAAATGTCATTTGGACTGAG
GGTGGCATTTGATAGTGTGTCATGAATTTGAGAATGTTGTTGGCTTAACAACAAAATCATTGCCAAGAGAAGTGA
TAAAAACTGTCAAATAAAGGCCAGGGAGCTACTGAGCAGCAGAGGTTCTGAGTTTTAGAAATTCTGGTTTTTAAA
TAGGCGCTACATTTGCATGACTCAAAAAGC
```

FIGURE 278

MTLVLSAAGHLHAFLWVSPTSHPEVFHLLPGCEQQFPCGKSSFRAASRRLTSPSSSARVSSWLRPPPPPWPGAPC
RSSRRSSRMASFCQLEENSAARASRRRSRECTRDITRCSAWKGRERATE

FIGURE 279

AAGGACACGGGCAGCAGACAGTGGTCAGTCCTTTCTTGGCTCTGCTGACACTCGAGCCCACATTCCGTCACCTGC
TCAGAATCATGCAGGTCTCCACTGCTGCCCTTGCTGTCCTCCTCTGCACCATGGCTCTCTGCAACCAGTTCTCTG
CATCACTTGCTGCTGACACGCCGACCGCCTGCTGCTTCAGCTACACCTCCCGGCAGATTCCACAGAATTTCATAG
CTGACTACTTTGAGACGAGCAGCCAGTGCTCCAAGCCCGGTGTCATCTTCCTAACCAAGCGAAGCCGGCAGGTCT
GTGCTGACCCCAGTGAGGAGTGGGTCCAGAAATATGTCAGCGACCTAGAGCTGAGTGCCTGAGGGTCCAGAAGC
TTCGAGGCCCAGCGACCTCGGTGGGCCAGTGGGGAGGAGCAGGAGCCTGAGCCTTGGGAAACATGCGTGTGACCT
CCACAGCTACCTCTTCTATGGACTGGTTGTTGCCAAACAGCCACACTGTGGGACTCTTCTTAACTTAAATTTTAA
TTTATTTATACTATTTAGTTTTTGTAATTTATTTTCGATTTCACAGTGTGTTTGTGATTGTTTGCTCTGAGAGTT
CCCCTGTCCCCTCCCCCTTCCCTCACACCGCGTCTGGTGACAACCGAGTGGCTGTCATCAGCCTGTGTAGGCAGT
CATGGCACCAAAGCCACCAGACTGACAAATGTGTATCGGATGCTTTTGTTCAGGGCTGTGATCGGCCTGGGGAAA
TAATAAAGCACGCTCTTTTAAAAGGT

FIGURE 280

MQVSTAALAVLLCTMALCNQFSASLAADTPTACCFSYTSRQIPQNFIADYFETSSQCSKPGVIFLTKRSRQVCAD
PSEEWVQKYVSDLELSA

FIGURE 281

```
TCTAGACAGTGGCGCAAGAGACTGGGGTTGCACTGGGACTCCAGGAAAGGCTTAGCTGTTGACGAAGGACCGGGG
CGGGGCCGGGGGGCGGGGCGAAGGCCAGGATCTCCAGGTACCCGGAACCCCAAGGGGCGGGTGTAGCAGGCAATC
TTGGCGAAACTGGGAAGGGCGGGCAGGAGGGCAGGGAAGCCGCTCACCCAGGCACAAAGCGCCTCCCGCTTGAGC
GGACTCCAAAGGGACGGTCCGCGGTGTGCAGCGAGCTGCGCTCAGGGGACCTTGCGCCCGGCCCTTCTGCTGCAC
ACAGCCCACCCAGGACCTCCCGCAGCGCTGACAGGCGGGGCGGGTGCAAAGACGGGGCGGGGTCTCTGCGCCCGG
CCCCCTCCCCTGACTATCAAAGCAGCGGCCGGCTGTTTGGGTCCACCACGCCTTCCACCTGCCCCACTGCTTCTT
CGCTTCTCTCTTGGAAAGTCCAGTCTCTCCTCGGCTTGCAATGGACCCCAACTGCTCCTGCGCCGCTGGTAAGGA
ACGCCGGGTTCCGTGCCTGGGGATGCTCGATTCCCAGACACCATAGAGAGTGTTCCTGGGTTTGAGAAGGTCGTA
TTTTGAGATCTCAACTGTAGGGGACTCCTTGACTTAGTCCAGTGCTTTCCTCTTGGCCAAGATCCTGAGAGCATT
TCCTTCCTCTCTGTGCCTCTGTGTCAGCGTTGAGGGTACTGAGGCTCAAGGCTGTCCTGCTCCACGTCATGCGGT
TTGTCCCAGGGCTGTTGGCTGAGCCCCAGTGCTCTGACCAGGCTTTGAGCAGCAGGATTAGATAGGAGGCAGGGG
ACATTGCCTCTTCGGGGTTCAGGACAGAAAGTCGAAGTCGCCGTCTTCCCAGGCTGTGCCTGGAGCCTGGGACTT
TCCTTTGGAGTGCAAACAGGAGGCTGCTTGGCCTTCCCAGCATGAAGGGAGAGGACATGGGGCTTCTCTTCCTCT
GCTCTGAGTGGGAAAGGAGCTCTGAGGGCTGGCCCCGCACAGAGGAGGGGGCAATGGAGACTCATTAACTCACTG
CTGTACCTCCTGCAGGTCACTCGCCGCTCACTGGCTTTTTTTCTCTTTCTCGCAGGTGTCTCCTGCACCTGCGC
TGGTTCCTGCAAGTGCAAAGAGTGCAAATGCACCTCCTGCAAGAAGAGTGAGTGTGAGGCCATCTCCATGGTCTG
GGGCTGTGGCTAAGGTTGGGATGGAACCCAAGGCTGGCCCTGAGTGCATGCTTCTGGGGAACTGGCCTTCCTTTG
TCCCCGTAGGTTGTCACTGCCTTTCTAGTCTTCTGCCCTGTGCAGGGCGCCTGGGCAGCTTTCTCATAGGAAGAC
CCACCCCAGATATTTCCCAGTTGTCTCCTGACAAAGCCATACCCTCCTGAACTGAGGGTCCTTTGTGGCTGGAGG
CTCTGTTGGGGGCCTCTGTTGGGGAGGGAGGTCCCTGGGCAAGTTGGCTGTGACCTCTCATGCTCCTCTTCTTCC
CCAGGCTGCTGCTCCTGCTGCCCCGTGGGCTGTAGCAAGTGTGCCCAGGGCTGTGTTTGCAAAGGGGCGTCAGAG
AAGTGCAGCTGCTGCGACTGATGCCAGGACAACCTTTCTCCCAGATGTAAACAGAGAGACATGTACAAACCTGGA
TTTTTTTTTATACCACCTTGACCCATTTGCTACATTCCTTTTCCTGTGAAATATGTGAGTGATAATTAAACACT
TTAGACCTGATTCTGACTTCAGTTTCCCTTATGTGCTTCAGAAATCAGAGACTGGGGTGGGGGATCGAACTAGGG
TTGCAGACTCCTGGGCTCTAAATGGAAATCTGAGTCCCTAACAATCAGAGTGCATTAAGGCAAGCCAGGCTGCCT
CACTGTGCTTCCTCTTCTGTAGAATGGAATAACACTTCATCAGGTCATTGGTGGGGATCC
```

FIGURE 282

MDPNCSCAAGVSCTCAGSCKCKECKCTSCKKSCCSCCPVGCSKCAQGCVCKGASEKCSCCD

FIGURE 283

```
GAATTCCGATTAGTGTGATCTCAGCTCAAGGCAAAGGTGGGATATCATGGCATCTATCTGGGTTGGACACCGAGG
AACAGTAAGAGATTATCCAGACTTTAGCCCATCAGTGGATGCTGAAGCTATTCAGAAAGCAATCAGAGGAATTGG
AACTGATGAGAAAATGCTCATCAGCATTCTGACTGAGAGGTCAAATGCACAGCGGCAGCTGATTGTTAAGGAATA
TCAAGCAGCATATGGAAAGGAGCTGAAAGATGACTTGAAGGGTGATCTCTCTGGCCACTTTGAGCATCTCATGGT
GGCCCTAGTGACTCCACCAGCAGTCTTTGATGCAAAGCAGCTAAAGAAATCCATGAAGGGCGCGGGAACAAACGA
AGATGCCTTGATTGAAATCTTAACTACCAGGACAAGCAGGCAAATGAAGGATATCTCTCAAGCCTATTATACAGT
ATACAAGAAGAGTCTTGGAGATGACATTAGTTCCGAAACATCTGGTGACTTCCGGAAAGCTCTGTTGACTTTGGC
AGATGGCAGAAGAGATGAAAGTCTGAAAGTGGATGAGCATCTGGCCAAACAAGATGCCCAGATTCTCTATAAAGC
TGGTGAGAACAGATGGGGCACGGATGAAGACAAATTCACTGAGATCCTGTGTTTAAGGAGCTTTCCTCAATTAAA
ACTAACATTTGATGAATACAGAAATATCAGCCAAAAGGACATTGTGGACAGCATAAAAGGAGAATTATCTGGGCA
TTTTGAAGACTTACTGTTGGCCATAGTTAATTGTGTGAGGAACACGCCGGCCTTTTTAGCCGAAAGACTGCATCG
AGCCTTGAAGGGTATTGGAACTGATGAGTTTACTCTGAACCGAATAATGGTGTCCAGATCAGAAATTGACCTTTT
GGACATTCGAACAGAGTTCAAGAAGCATTATGGCTATTCCCTATATTCAGCAATTAAATCGGATACTTCTGGAGA
CTATGAAATCACACTCTTAAAAATCTGTGGTGGAGATGACTGAACCAAGAAGATAATCTCCAAAGGTCCACGATG
GGCTTTCCCAACAGCTCCACCTTACTTCTTCTCATACTATTTAAGAGAACAAGCAAATATAAACAGCAACTTGTG
TTCCTAACAGGAATTTTCATTGTTCTATAACAACAACAACAAAAGCGATTATTATTTTAGAGCATCTCATTTATA
ATGTAGCAGCTCATAAATGAAATTGAAAATGGTATTAAAGATCTGCAACTACTATCCAACTTATATTTCTGCTTT
CAAAGTTAAGAATCTTTATAGTTCTACTCCATTAAATATAAAGCAAGATAATAAAACGGAATTC
```

FIGURE 284

MASIWVGHRGTVRDYPDFSPSVDAEAIQKAIRGIGTDEKMLISILTERSNAQRQLIVKEYQAAYGKELKDDLKGD
LSGHFEHLMVALVTPPAVFDAKQLKKSMKGAGTNEDALIEILTTRTSRQMKDISQAYYTVYKKSLGDDISSETSG
DFRKALLTLADGRRDESLKVDEHLAKQDAQILYKAGENRWGTDEDKFTEILCLRSFPQLKLTFDEYRNISQKDIV
DSIKGELSGHFEDLLLAIVNCVRNTPAFLAERLHRALKGIGTDEFTLNRIMVSRSEIDLLDIRTEFKKHYGYSLY
SAIKSDTSGDYEITLLKICGGDD

FIGURE 285A

```
GCCCCAGCACTCGCCGGCGGCAGTGAAAGGACGCGCCGGAGCCGGATAACAGAAAGTAACGTGAAGGAATTCAGG
TGACTCAGACATGGAGGAGAGAAGACCTCATCTGGATGCCAGGCCCAGGAATTCCCATACCAACCACAGAGGCCC
TGTGGATGGAGAGTTACCACCAAGAGCTAGAAATCAGGCCAATAACCCACCAGCCAATGCTCTCCGAGGAGGAGC
CAGCCACCCTGGAAGGCATCCTAGGGCCAACAACCATCCTGCTGCTTACTGGCAGAGGGAAGAGAGATTTAGGGC
CATGGGCAGGAACCCACATCAAGGAAGGAGGAACCAGGAGGGGCATGCCAGCGACGAAGCTAGAGACCAAAGACA
TGACCAGGAGAATGACACCAGGTGGAGAAATGGCAACCAGGACTGTAGGAACCGCAGACCACCATGGTCCAATGA
CAACTTCCAGCAGTGGCGGACTCCCCACCAGAAGCCTACAGAACAGCCACAGCAGGCGAAGAAACTGGGCTACAA
GTTCTTAGAAAGTCTTCTGCAGAAAGACCCTTCTGAGGTGGTCATCACACTTGCCACAAGTTTAGGGCTGAAAGA
GCTCCTTTCTCATTCTTCCATGAAATCTAACTTCCTTGAGCTCATCTGTCAGGTTCTTCGGAAGGCTTGTAGCTC
CAAAATGGATCGCCAGAGTGTTCTCCATGTACTGGGCATATTGAAAAACTCCAAATTTCTCAAAGTCTGCCTGCC
TGCTTATGTGGTAGGGATGATCACTGAACCCATCCCTGACATCCGAAACCAGTATCCAGAGCACATAAGCAACAT
CATCTCCCTCCTCCAGGACCTTGTAAGTGTCTTCCCTGCCAGCTCTGTGCAGGAAACTTCCATGCTGGTTTCCCT
CCTGCCAACCTCTCTTAATGCTCTGAGAGCCTCTGGTGTTGACATAGAAGAGGAAACGGAGAAGAACCTGGAAAA
GGTACAGACTATCATTGAACATCTGCAGGAAAAGAGGCGAGAGGGCACTTTGAGAGTGGATACCTACACTCTAGT
GCAGCCTGAGGCAGAAGACCATGTTGAGAGCTACCGAACCATGCCCATTTACCCTACCTACAATGAAGTGCACTT
GGATGAGAGGCCCTTCCTTCGCCCCAATATCATTTCTGGAAAATACGACAGCACTGCTATCTATCTGGATACCCA
CTTCCGGCTCCTGCGAGAAGATTTCGTCAGACCTTTACGGGAAGGTATTTGGAACTTCTCCAAAGCTTTGAAGA
CCAGGGCCTGAGGAAGAGAAAGTTTGATGACATCCGAATCTACTTTGACACCAGGATTATCACCCCCATGTGTTC
ATCATCAGGCATAGTCTACAAGGTGCAGTTTGACACAAAACCACTGAAGTTTGTTCGCTGGCAGAATTCCAAACG
ATTGCTCTATGGGTCTTTGGTATGCATGTCCAAGGACAACTTCGAGACATTTCTTTTTGCCACCGTATCTAACAG
GGAGCAGGAAGATCTCTGCCGAGGAATTGTCCAGCTCTGCTTCAATGAGCAAAGCCAACAGCTGCTAGCAGAGGT
CCAGCCCTCTGACTCTTTCCTCATGGTAGAGACAACTGCATACTTTGAGGCCTACAGGCACGTCCTGGAAGGACT
CCAGGAGGTCCAGGAGGAAGATGTTCCCTTCCAGAGGAATATCGTGGAGTGTAACTCTCATGTGAAGGAGCCAAG
GTACTTGCTAATGGGGGGCAGATATGACTTTACCCCCTTAATAGAGAATCCTTCAGCCACTGGGGAATTTCTAAG
AAATGTCGAGGGTTTGAGACATCCCAGAATTAATGTCTTAGATCCTGGCCAGTGGCCCTCAAAAGAAGCCCTGAA
GCTGGATGACTCCCAGATGGAAGCCTTGCAGTTTGCTCTCACAAGGGAACTGGCTATTATTCAAGGACCTCCTGG
AACAGGCAAAACCTATGTGGGTCTAAAAATTGTTCAGGCCCTCCTAACCAACGAGTCTGTTTGGCAAATTAGCCT
CCAGAAGTTCCCCATCTTGGTTGTGTGTTATACTAATCATGCTTTGGACCAGTTTCTGGAAGGCATCTACAATTG
TCAGAAGACCAGCATTGTGCGGGTGGGTGGAAGGAGCAACAGTGAAATCCTGAAGCAGTTCACCCTAAGGGAGCT
GAGGAACAAGCGGGAATTCCGCCGCAACCTCCCCATGCACCTCCGAAGGGCCTACATGAGTATCATGACACAGAT
GAAGGAGTCAGAGCAAGAGCTTCATGAAGGAGCCAAGACCCTGGAGTGCACCATGCGTGGTGTCCTACGGGAACA
GTACCTGCAGAAGTACATCTCACCCCAGCACTGGGAAAGTCTCATGAATGGACCAGTGCAGGATAGTGAATGGAT
TTGCTTCCAGCACTGGAAGCATTCCATGATGCTGGAGTGGCTAGGTCTTGGTGTCGGTTCTTTCACGCAAAGTGT
TTCTCCAGCAGGACCTGAGAATACAGCCCAGGCAGAAGGGGATGAGGAGGAAGAAGGGGAGGAGGAGAGTTCGCT
GATAGAGATCGCAGAGGAAGCTGACCTGATTCAAGCAGACCGGGTGATTGAGGAGGAAGAGGTGGTGAGGCCCCA
GCGGCGGAAGAAGGAAGAGAGTGGAGCAGACCAGGAGTTGGCTAAAATGCTTCTGGCCATGAGGCTAGACCATTG
TGGCACTGGGACAGCAGCTGGACAGGAGCAAGCCACAGGAGAGTGGCAGACCCAGCGCAACCAGAAAAAGAAAAT
GAAAAAAAGAGTGAAGGATGAGCTTCGCAAACTGAACACCATGACTGCAGCCGAGGCCAACGAGATCGAGGATGT
TTGGCACCTGGACCTCAGTTCTCGCTGGCAGCTTTATAGGCTCTGGCTACAGTTGTACCAGGCTGACACCCGCCG
GAAGATCCTCAGCTATGAACGCCAGTACCGCACATCAGCAGAAAGAATGGCCGAGCTGAGACTCCAGGAAGACCT
GCACATTCTTAAAGATGCCCAGGTTGTAGGAATGACAACCACAGGTGCTGCCAAATACCGCCAGATCCTACAGAA
GGTGGAGCCGAGGATTGTCATAGTGGAAGAAGCTGCGGAAGTCCTTGAGGCCCATACCATTGCCACATTGAGCAA
AGCTTGCCAGCACCTCATTTTGATTGGGGACCACCAGCAGCTGCGCCCCAGTGCCAACGTGTATGATCTGGCCAA
GAACTTCAACCTTGAGGTGTCCCTTTTTGAACGGCTAGTGAAAGTAAACATTCCCTTTGTCCGTCTGAATTACCA
GCACCGTATGTGCCCTGAAATTGCCCGCCTTTTGACCCCCACATTTACCAGGATCTGGAGAATCATCCATCTGT
TCTTAAGTATGAGAAGATTAAGGGGGTGTCTTCCAACCTTTTCTTTGTAGAACACAACTTTCCTGAACAGGAAAT
CCAAGAGGGCAAAAGCCATCAGAACCAGCATGAGGCTCACTTTGTGGTAGAGCTGTGCAAGTACTTCCTGTGCCA
GGAATACCTGCCTTCCCAGATCACCATCCTCACTACCTATACCGGGCAGCTCTTCTGCCTGCGCAAACTGATGCC
```

FIGURE 285B

```
TGCCAAGACATTTGCTGGCGTCAGGGTCCATGTTGTGGACAAATACCAAGGGGAAGAGAATGACATCATCCTCCT
CTCGCTAGTGCGGAGCAACCAAGAAGGCAAGGTGGGTTTTCTGCAGATATCCAACCGCATCTGTGTGGCCTTGTC
CCGAGCCAAGAAGGGAATGTACTGCATCGGAAACATGCAGATGCTGGCCAAGGTGCCCCTGTGGAGCAAGATCAT
TCATACACTTCGAGAGAACAATCAAATAGGCCCCATGCTCCGGCTCTGCTGCCAGAACCACCCTGAAACCCACAC
CTTAGTATCCAAAGCTTCTGACTTCCAAAAAGTACCCGAAGGAGGCTGCAGCCTGCCCTGCGAGTTCCGCCTGGG
CTGTGGGCATGTCTGCACCCGTGCCTGCCACCCTTATGACTCTTCACACAAGGAGTTCCAATGCATGAAGCCATG
CCAGAAGGTCATCTGTCAGGAAGGGCACCGGTGTCCCCTTGTTTGCTTCCAGGAGTGTCAGCCTTGTCAGGTGAA
GGTGCCCAAAATCATTCCTCGGTGCGGCCATGAACAAATGGTCCCTTGTTCCGTGCCTGAGTCAGATTTCTGCTG
CCAGGAGCCTTGCTCCAAGTCTCTGAGATGTGGGCACAGATGCAGCCACCCATGTGGTGAGGACTGTGTGCAGTT
GTGTTCAGAAATGGTCACCATAAAACTCAAGTGTGGGCACAGTCAACCGGTAAAATGTGGTCATGTGGAAGGCCT
CCTGTATGGTGGTCTGCTAGTCAAGTGTACCACAAAGTGTGGCACTATCTTGGACTGCGGGCATCCTTGCCCAGG
CTCCTGCCACAGCTGCTTCGAAGGGCGTTTCCATGAACGCTGTCAGCAGCCCTGCAAGCGCCTGCTTATCTGCTC
ACACAAGTGCCAGGAACCATGCATTGGTGAGTGCCCACCCTGCCAGCGGACCTGTCAGAACCGCTGTGTCCACAG
CCAGTGCAAGAAGAAATGTGGGGAGCTGTGTAGTCCCTGCGTGGAACCCTGTGTCTGGCGCTGCCAGCACTACCA
GTGCACCAAACTCTGCTCTGAGCCCTGCAACCGACCCCCATGCTATGTGCCTTGTACTAAGCTGCTAGTTTGTGG
CCACCCCTGCATTGGTCTCTGTGGGGAGCCATGCCCCAAGAAATGCCGGATCTGCCACATGGATGAGGTCACCCA
AATATTCTTTGGCTTTGAGGATGAGCCTGATGCCCGCTTTGTGCAGCTGGAAGACTGCAGCCACATCTTTGAGGT
GCAAGCCCTAGACCGCTACATGAATGAACAGAAGGATGATGAAGTCGCCATCAGATTGAAAGTCTGCCCTATCTG
CCAGGTGCCCATCCGCAAAAACCTGAGGTATGGAACTAGCATAAAACAGCGGCTAGAAGAGATTGAAATCATCAA
GGAAAAGATCCAGGGCTCAGCAGGGGAAATAGCAACCAGCCAGGAACGGCTTAAGGCCCTGCTGGAGAGGAAGAG
CCTCCTCCACCAGCTGCTTCCTGAAGACTTCCTGATGTTAAAGGAGAAGCTGGCCCAGAAAAATCTGTCAGTGAA
GGACCTGGGTCTGGTTGAGAATTACATCAGCTTCTATGACCACCTGGCCAGCCTGTGGGATTCCCTGAAAAAGAT
GCATGTCTTAGAAGAGAAAAGAGTGAGGACTCGACTAGAACAGGTCCATGAGTGGCTGGCCAAGAAGCGCTTGAG
CTTCACTAGCCAGGAACTAAGTGACCTCCGAAGTGAAATCCAGAGGCTCACATACCTGGTGAACCTTCTGACCCG
CTACAAGATAGCAGAGAAGAAGGTGAAAGATAGCATAGCAGTAGAGGTCTATAGTGTCCAGAATATCCTTGAGAA
AACATGTAAGTTCACCCAAGAGGATGAACAACTTGTGCAGGAAAAGATGGAAGCTCTGAAAGCCACCCTTCCCTG
CTCTGGCCTGGGCATCTCAGAGGAAGAGCGAGTGCAGATTGTCAGTGCCATAGGTTATCCTCGTGGTCACTGGTT
CAAGTGCCGCAATGGCCATATCTATGTGATTGGCGATTGTGGGGGAGCCATGGAGAGGGGCACGTGTCCTGACTG
TAAGGAAGTGATTGGTGGCACAAATCATACTCTGGAAAGAAGCAACCAGCTTGCTTCTGAAATGGATGGAGCCCA
GCATGCTGCCTGGTCTGACACGGCCAACAACCTGATGAACTTTGAGGAGATCCAGGGGATGATGTAGGAAGATGG
TACACCACTGCCTTTTGCCCTCGCCACTGAATGACTGGGGCCAGCTCCCTAATGAAGGAACTGAAGTTTGTTTTT
TATTATCATCCTTTTTAGGCTGGGCGCAGTGGCTTACGCCTGTAATCCCAGCACTTTGGGAGGCCGAGGCAGGCG
GATCACGAGGTCAGGAGTTCGAGACCAGCCTGACCAACATGGCGAAACCCGTCTCTACTAAAAATACAAAAATT
AGCTGGGCGTTATGGCGGGCGCCTGTAATCCCAGCTACTTGGGAGGCTGAGGCAGAAGAATCGCTTAAACCCAGG
AGGCGGAGGTTGCAGTGAGCTGAGATCATGCCATTGCACTCCAGTCTGGGCGACAGGAGCAAGACTCTGTCTCAA
AAAAAAAAAATCATTCTTTTAGTCTTAGCACCTACTTAAGGATCCACTTTTAGGGCTCACCCACATTTGTTTCT
AGATTTACCCCTGCGCTAGAGTAAGCACTTTATCTCCAGAACTGAGAGCAAAGTTAACAAATCTCACCCCTTCTC
TCCTGCAAATTAGTGGACAGACTCCCTGGAACATGTTTGGGGCTTCCACCTAGGGCCACCTAGTGGTATCTCTGG
GTCTTTACTTGGTCAGATGTTTATTCTACATTGTTCCCCAGGAACAGAGTATGAGCTCATTGATGCAGACCGATT
CTAATTGCCAGGCCCTAATTTGCAGACTAACTCTCATAATAAACAGAGGCCCATAGTTGTTTATGAACTGCTTAT
CCCTTAAAGGAGCACAAGAACCCCTCCCTGCCCTCCTTGGGCACCCTGCCTCCAGGAGATGGAGGCACGTGATAA
GACAAAAGACTGCACCAACTCACCCTGACACAGTTACATAGTCACTGAGAGTGGGGAAGATGGGACAGCCCACAT
GCTGCATAAGATGGGCCTTATGCAGCAGGCCAGGTCGTCATTAAGGAGTGACCCCTTCCTGTAACCTGCACTT
TGGGATGGTAGAAGTTTCTTTACCTGCTGACAGGTTTGGTGGCACTGCTGGTTACCCCTGGGCCCTGAATGGAGC
TAAAATCACATTTGGTACCAGCAGCACCTATCCCAAGTGTGATCCTTCATCCCAACACTCCCTCTTGGAGCTGTT
CCCTGGGTAGAGCTAGCATGCCAGCAGCTTCTGCAGGCTCCAAACCCAGGCCAGAAGCCAGACCCAGGCCTGCTG
CCTGCATCTGCATTCCCTCCTTCCAGTGTTCCTTAGAACAGACATTTAGGTATCTCAGGTCCTTTCTAAGTGTCC
CTTTCCTATGTATGCATTTCCTTTTTTTGTCTTTACTATGCACTTTAGCTTATAAAGCCAATTAAAAACGATGAT
```

FIGURE 285C

```
TGAG
```

FIGURE 286

```
RNSGDSDMEERRPHLDARPRNSHTNHRGPVDGELPPRARNQANNPPANALRGGASHPGRHPRANNHPAAYWQREE
RFRAMGRNPHQGRRNQEGHASDEARDQRHDQENDTRWRNGNQDCRNRRPPWSNDNFQQWRTPHQKPTEQPQQAKK
LGYKFLESLLQKDPSEVVITLATSLGLKELLSHSSMKSNFLELICQVLRKACSSKMDRQSVLHVLGILKNSKFLK
VCLPAYVVGMITEPIPDIRNQYPEHISNIISLLQDLVSVFPASSVQETSMLVSLLPTSLNALRASGVDIEEETEK
NLEKVQTIIEHLQEKRREGTLRVDTYTLVQPEAEDHVESYRTMPIYPTYNEVHLDERPFLRPNIISGKYDSTAIY
LDTHFRLLREDFVRPLREGILELLQSFEDQGLRKRKFDDIRIYFDTRIITPMCSSSGIVYKVQFDTKPLKFVRWQ
NSKRLLYGSLVCMSKDNFETFLFATVSNREQEDLCRGIVQLCFNEQSQQLLAEVQPSDSFLMVETTAYFEAYRHV
LEGLQEVQEEDVPFQRNIVECNSHVKEPRYLLMGGRYDFTPLIENPSATGEFLRNVEGLRHPRINVLDPGQWPSK
EALKLDDSQMEALQFALTRELAIIQGPPGTGKTYVGLKIVQALLTNESVWQISLQKFPILVVCYTNHALDQFLEG
IYNCQKTSIVRVGGRSNSEILKQFTLRELRNKREFRRNLPMHLRRAYMSIMTQMKESEQELHEGAKTLECTMRGV
LREQYLQKYISPQHWESLMNGPVQDSEWICFQHWKHSMMLEWLGLGVGSFTQSVSPAGPENTAQAEGDEEEEGEE
ESSLIEIAEEADLIQADRVIEEEEVVRPQRRKKEESGADQELAKMLLAMRLDHCGTGTAAGQEQATGEWQTQRNQ
KKKMKKRVKDELRKLNTMTAAEANEIEDVWHLDLSSRWQLYRLWLQLYQADTRRKILSYERQYRTSAERMAELRL
QEDLHILKDAQVVGMTTTGAAKYRQILQKVEPRIVIVEEAAEVLEAHTIATLSKACQHLILIGDHQQLRPSANVY
DLAKNFNLEVSLFERLVKVNIPFVRLNYQHRMCPEIARLLTPHIYQDLENHPSVLKYEKIKGVSSNLFFVEHNFP
EQEIQEGKSHQNQHEAHFVVELCKYFLCQEYLPSQITILTTYTGQLFCLRKLMPAKTFAGVRVHVVDKYQGEEND
IILLSLVRSNQEGKVGFLQISNRICVALSRAKKGMYCIGNMQMLAKVPLWSKIIHTLRENNQIGPMLRLCCQNHP
ETHTLVSKASDFQKVPEGGCSLPCEFRLGCGHVCTRACHPYDSSHKEFQCMKPCQKVICQEGHRCPLVCFQECQP
CQVKVPKIIPRCGHEQMVPCSVPESDFCCQEPCSKSLRCGHRCSHPCGEDCVQLCSEMVTIKLKCGHSQPVKCGH
VEGLLYGGLLVKCTTKCGTILDCGHPCPGSCHSCFEGRFHERCQQPCKRLLICSHKCQEPCIGECPPCQRTCQNR
CVHSQCKKKCGELCSPCVEPCVWRCQHYQCTKLCSEPCNRPPCYVPCTKLLVCGHPCIGLCGEPCPKKCRICHMD
EVTQIFFGFEDEPDARFVQLEDCSHIFEVQALDRYMNEQKDDEVAIRLKVCPICQVPIRKNLRYGTSIKQRLEEI
EIIKEKIQGSAGEIATSQERLKALLERKSLLHQLLPEDFLMLKEKLAQKNLSVKDLGLVENYISFYDHLASLWDS
LKKMHVLEEKRVRTRLEQVHEWLAKKRLSFTSQELSDLRSEIQRLTYLVNLLTRYKIAEKKVKDSIAVEVYSVQN
ILEKTCKFTQEDEQLVQEKMEALKATLPCSGLGISEEERVQIVSAIGYPRGHWFKCRNGHIYVIGDCGGAMERGT
CPDCKEVIGGTNHTLERSNQLASEMDGAQHAAWSDTANNLMNFEEIQGMM
```

FIGURE 287

```
AAGAGATGATTTCTCCATCCTGAACGTGCAGCGAGCTTGTCAGGAAGATCGGAGGTGCCAAGTAGCAGAGAAAGC
ATCCCCCAGCTCTGACAGGGAGACAGCACATGTCTAAGGCCCACAAGCCTTGGCCCTACCGGAGGAGAAGTCAAT
TTTCTTCTCGAAAATACCTGAAAAAAGAAATGAATTCCTTCCAGCAACAGCCACCGCCATTCGGCACAGTGCCAC
CACAAATGATGTTTCCTCCAAACTGGCAGGGGGCAGAGAAGGACGCTGCTTTCCTCGCCAAGGACTTCAACTTTC
TCACTTTGAACAATCAGCCACCACCAGGAAACAGGAGCCAACCAAGGGCAATGGGGCCCGAGAACAACCTGTACA
GCCAGTACGAGCAGAAGGTGCGCCCCTGCATTGACCTCATCGACTCCCTGCGGGCTCTGGGTGTGGAGCAGGACC
TGGCCCTGCCAGCCATCGCCGTCATCGGGGACCAGAGCTCGGGCAAGAGCTCTGTGCTGGAGGCACTGTCAGGAG
TCGCGCTTCCCAGAGGCAGCGGAATCGTAACCAGGTGTCCGCTGGTGCTGAAACTGAAAAAGCAGCCCTGTGAGG
CATGGGCCGGAAGGATCAGCTACCGGAACACCGAGCTAGAGCTTCAGGACCCTGGCCAGGTGGAGAAAGAGATAC
ACAAAGCCCAGAACGTCATGGCCGGGAATGGCCGGGGCATCAGCCATGAGCTCATCAGCCTGGAGATCACCTCCC
CTGAGGTTCCAGACCTGACCATCATTGACCTTCCCGGCATCACCAGGGTGGCTGTGGACAACCAGCCCCGAGACA
TCGGACTGCAGATCAAGGCTCTCATCAAGAAGTACATCCAGAGGCAGCAGACGATCAACTTGGTGGTGGTTCCCT
GTAACGTGGACATTGCCACCACGGAGGCGCTGAGCATGGCCCATGAGGTGGACCCGGAAGGGGACAGGACCATCG
GTATCCTGACCAAACCAGATCTAATGGACAGGGGCACTGAGAAAAGCGTCATGAATGTGGTGCGGAACCTCACGT
ACCCCCTCAAGAAGGGCTACATGATTGTGAAGTGCCGGGGCCAGCAGGAGATCACAAACAGGCTGAGCTTGGCAG
AGGCAACCAAGAAAGAAATTACATTCTTTCAAACACATCCATATTTCAGAGTTCTCCTGGAGGAGGGTCAGCCA
CGGTTCCCCGACTGGCAGAAAGACTTACCACTGAACTCATCATGCATATCCAAAAATCGCTCCCGTTGTTAGAAG
GACAAATAAGGGAGAGCCACCAGAAGGCGACCGAGGAGCTGCGGCGTTGCGGGGCTGACATCCCCAGCCAGGAGG
CCGACAAGATGTTCTTTCTAATTGAGAAAATCAAGATGTTTAATCAGGACATCGAAAAGTTAGTAGAAGGAGAAG
AAGTTGTAAGGGAGAATGAGACCCGTTTATACAACAAAATCAGAGAGGATTTTAAAAACTGGGTAGGCATACTTG
CAACTAATACCCAAAAAGTTAAAAATATTATCCACGAAGAAGTTGAAAAATATGAAAAGCAGTATCGAGGCAAGG
AGCTTCTGGGATTTGTCAACTACAAGACATTTGAGATCATCGTGCATCAGTACATCCAGCAGCTGGTGGAGCCCG
CCCTTAGCATGCTCCAGAAAGCCATGGAAATTATCCAGCAAGCTTTCATTAACGTGGCCAAAAAACATTTTGGCG
AATTTTTCAACCTTAACCAAACTGTTCAGAGCACGATTGAAGACATAAAAGTGAAACACACAGCAAAGGCAGAAA
ACATGATCCAACTTCAGTTCAGAATGGAGCAGATGGTTTTTTGTCAAGATCAGATTTACAGTGTTGTTCTGAAGA
AAGTCCGAGAAGAGATTTTTAACCCTCTGGGGACGCCTTCACAGAATATGAAGTTGAACTCTCATTTTCCCAGTA
ATGAGTCTTCGGTTTCCTCCTTTACTGAAATAGGCATCCACCTGAATGCCTACTTCTTGGAAACCAGCAAACGTC
TCGCCAACCAGATCCCATTTATAATTCAGTATTTTATGCTCCGAGAGAATGGTGACTCCTTGCAGAAAGCCATGA
TGCAGATACTACAGGAAAAAAATCGCTATTCCTGGCTGCTTCAAGAGCAGAGTGAGACCGCTACCAAGAGAAGAA
TCCTTAAGGAGAGAATTTACCGGCTCACTCAGGCGCGACACGCACTCTGTCAATTCTCCAGCAAAGAGATCCACT
GAAGGGCGGCGATGCCTGTGGTTGTTTCTTGTGCGTACTCATTCATTCTAAGGGGAGTCGGTGCAGGATGCCGC
TTCTGCTTTGGGGCCAAACTCTTCTGTCACTATCAGTGTCCATCTCTACTGTACTCCCTCAGCATCAGAGCATGC
ATCAGGGGTCCACACAGGCTCAGCTCTCTCCACCACCCAGCTCTTCCCTGACCTTCACGAAGGGATGGCTCTCCA
GTCCTTGGGTCCCGTAGCACACAGTTACAGTGTCCTAAGATACTGCTATCATTCTTCGCTAATTTGTATTTGTAT
TCCCTTCCCCCTACAAGATTATGAGACCCCAGAGGGGGAAGGTCTGGGTCAAATTCTTCTTTTGTATGTCCAGTC
TCCTGCACAGCACCTGCAGCATTGTAACTGCTTAATAAATGACATCTCACTGAACGAATGAGTGCTGTGTAAGTG
ATGGAGATACCTGAGGCTATTGCTCAAGCCCAGGCCTTGGACATTTAGTGACTGTTAGCCGGTCCCTTTCAGATC
CAGTGGCCATGCCCCTGCTTCCCATGGTTCACTGTCATTGTGTTTCCCAGCCTCTCCACTCCCCCGCCAGAAAG
GAGCCTGAGTGATTCTCTTTTCTTCTTGTTTCCCTGATTATGATGAGCTTCCATTGTTCTGTTAAGTCTTGAAGA
GGAATTTAATAAAGCAAAGAAACTTTTTAAAAACGT
```

FIGURE 288

```
MSKAHKPWPYRRRSQFSSRKYLKKEMNSFQQQPPPFGTVPPQMMFPPNWQGAEKDAAFLAKDFNFLTLNNQPPPG
NRSQPRAMGPENNLYSQYEQKVRPCIDLIDSLRALGVEQDLALPAIAVIGDQSSGKSSVLEALSGVALPRGSGIV
TRCPLVLKLKKQPCEAWAGRISYRNTELELQDPGQVEKEIHKAQNVMAGNGRGISHELISLEITSPEVPDLTIID
LPGITRVAVDNQPRDIGLQIKALIKKYIQRQQTINLVVVPCNVDIATTEALSMAHEVDPEGDRTIGILTKPDLMD
RGTEKSVMNVVRNLTYPLKKGYMIVKCRGQQEITNRLSLAEATKKEITFFQTHPYFRVLLEEGSATVPRLAERLT
TELIMHIQKSLPLLEGQIRESHQKATEELRRCGADIPSQEADKMFFLIEKIKMFNQDIEKLVEGEEVVRENETRL
YNKIREDFKNWVGILATNTQKVKNIIHEEVEKYEKQYRGKELLGFVNYKTFEIIVHQYIQQLVEPALSMLQKAME
IIQQAFINVAKKHFGEFFNLNQTVQSTIEDIKVKHTAKAENMIQLQFRMEQMVFCQDQIYSVVLKKVREEIFNPL
GTPSQNMKLNSHFPSNESSVSSFTEIGIHLNAYFLETSKRLANQIPFIIQYFMLRENGDSLQKAMMQILQEKNRY
SWLLQEQSETATKRRILKERIYRLTQARHALCQFSSKEIH
```

FIGURE 289

GGCACGAGCCCAGAAACAAAGACTTCACGGACAAAGTCCCTTGGAACCAGAGAGAAGCCGGGATGGAAACTCCAA
ACACCACAGAGGACTATGACACGACCACAGAGTTTGACTATGGGGATGCAACTCCGTGCCAGAAGGTGAACGAGA
GGGCCTTTGGGGCCCAACTGCTGCCCCCTCTGTACTCCTTGGTATTTGTCATTGGCCTGGTTGGAAACATCCTGG
TGGTCCTGGTCCTTGTGCAATACAAGAGGCTAAAAAACATGACCAGCATCTACCTCCTGAACCTGGCCATTTCTG
ACCTGCTCTTCCTGTTCACGCTTCCCTTCTGGATCGACTACAAGTTGAAGGATGACTGGGTTTTTGGTGATGCCA
TGTGTAAGATCCTCTCTGGGTTTTATTACACAGGCTTGTACAGCGAGATCTTTTTCATCATCCTGCTGACGATTG
ACAGGTACCTGGCCATCGTCCACGCCGTGTTTGCCTTGCGGGCACGGACCGTCACTTTTGGTGTCATCACCAGCA
TCATCATTTGGGCCCTGGCCATCTTGGCTTCCATGCCAGGCTTATACTTTTCCAAGACCCAATGGGAATTCACTC
ACCACACCTGCAGCCTTCACTTTCCTCACGAAAGCCTACGAGAGTGGAAGCTGTTTCAGGCTCTGAAACTGAACC
TCTTTGGGCTGGTATTGCCTTTGTTGGTCATGATCATCTGCTACACAGGGATTATAAAGATTCTGCTAAGACGAC
CAAATGAGAAGAAATCCAAAGCTGTCCGTTTGATTTTGTCATCATGATCATCTTTTTCTCTTTTGGACCCCCT
ACAATTTGACTATACTTATTTCTGTTTTCCAAGACTTCCTGTTCACCCATGAGTGTGAGCAGAGCAGACATTTGG
ACCTGGCTGTGCAAGTGACGGAGGTGATCGCCTACACGCACTGCTGTGTCAACCCAGTGATCTACGCCTTCGTTG
GTGAGAGGTTCCGGAAGTACCTGCGGCAGTTGTTCCACAGGCGTGTGGCTGTGCACCTGGTTAAATGGCTCCCCT
TCCTCTCCGTGGACAGGCTGGAGAGGGTCAGCTCCACATCTCCCTCCACAGGGGAGCATGAACTCTCTGCTGGGT
TCTGACTCAGACCATAGGAGGCCAACCCAAAATAAGCAGGCGTGACCTGCCAGGCACACTGAGCCAGCAGCCTGG
CTCTCCCAGCCAGGTTCTGACTCTTGGCACAGCATGGAGTCACAGCCACTTGGGATAGAGAGGGAATGTAATGGT
GGCCTGGGGCTTCTGAGGCTTCTGGGGCTTCAGTCTTTTCCATGAACTTCTCCCCTGGTAGAAAGAAGATGAATG
AGCAAAACCAAATATTCCAGAGACTGGGACTAAGTGTACCAGAGAAGGGCTTGGACTCAAGCAAGATTTCAGATT
TGTGACCATTAGCATTTGTCAACAAAGTCACCCACTTCCCACTATTGCTTGCACAAACCAATTAAACCCAGTAGT
GGTGACTGTGGGCTCCATTCAAAGTGAGCTCCTAAGCCATGGGAGACACTGATGTATGAGGAATTTCTGTTCTTC
CATCACCTCCCCCCCCCCGCCACCCTCCCACTGCCAAGAACTTGGAAATAGTGATTTCCACAGTGACTCCACTCT
GAGTCCCAGAGCCAATCAGTAGCCAGCATCTGCCTCCCCTTCACTCCCACCGCAGGATTTGGGCTCTTGGAATCC
TGGGGAACATAGAACTCATGACGGAAGAGTTGAGACCTAACGAGAAATAGAAATGGGGAACTACTGCTGGCAGT
GGAACTAAGAAAGCCCTTAGGAAGAATTTTTATATCCACTAAAATCAAACAATTCAGGGAGTGGGCTAAGCACGG
GCCATATGAATAACATGGTGTGCTTCTTAAAATAGCCATAAAGGGGAGGGACTCATCATTTCCATTTACCCTTCT
TTTCTGACTATTTTTCAGAATCTCTCTTCTTTTCAAGTTGGGTGATATGTTGGTAGATTCTAATGGCTTTATTGC
AGCGATTAATAACAGGCAAAAGGAAGCAGGGTTGGTTTCCCTTCTTTTTGTTCTTCATCTAAGCCTTCTGGTTTT
ATGGGTCAGAGTTCCGACTGCCATCTTGGACTTGTCAGCAAAAAAAAAAAAAAAAAA

FIGURE 290

METPNTTEDYDTTTEFDYGDATPCQKVNERAFGAQLLPPLYSLVFVIGLVGNILVVLVLVQYKRLKNMTSIYLLN
LAISDLLFLFTLPFWIDYKLKDDWVFGDAMCKILSGFYYTGLYSEIFFIILLTIDRYLAIVHAVFALRARTVTFG
VITSIIIWALAILASMPGLYFSKTQWEFTHHTCSLHFPHESLREWKLFQALKLNLFGLVLPLLVMIICYTGIIKI
LLRRPNEKKSKAVRLIFVIMIIFFLFWTPYNLTILISVFQDFLFTHECEQSRHLDLAVQVTEVIAYTHCCVNPVI
YAFVGERFRKYLRQLFHRRVAVHLVKWLPFLSVDRLERVSSTSPSTGEHELSAGF

FIGURE 291

```
TCCTGCCGCTTGGCCGCGGGGCGCCTGGCTCAGTGGCTTCTGCGGGCTTCGAGGAGCGGGATGTTGCGGGCTGGG
TGGCTCCGGGGCGCGGCGGCGCTGGCGCTGCTGCTGGCGGCCCGAGTGGTGGCGGCGTTCGAGCCCATCACCGTG
GGCCTAGCCATCGGGGCCGCGTCGGCCATCACCGGCTACCTGTCCTACAATGACATCTACTGCCGCTTCGCCGAG
TGCTGCCGCGAGGAGCGGCCGCTCAACGCTTCGGCTCTCAAGCTGGATTTGGAGGAGAAGCTGTTTGGACAGCAT
CTAGCCACGGAAGTGATTTTCAAGGCGCTGACTGGCTTCAGGAACAACAAAAATCCCAAGAAACCACTGACCCTT
TCCTTACACGGCTGGGCTGGCACAGGCAAGAATTTTGTCAGTCAAATTGTGGCTGAAAATCTTCACCCAAAAGGT
CTGAAGAGTAACTTTGTCCACCTGTTTGTATCGACTCTGCACTTCCCTCATGAGCAGAAGATAAAACTGTACCAG
GACCAGTTACAGAAGTGGATCCGCGGTAATGTGAGTGCATGTGCGAACTCTGTTTTCATATTTGACGAGATGGAT
AAATTGCACCCCGGGATCATTGACGCAATCAAGCCGTTTCTAGACTACTACGAGCAGGTTGACGGAGTGTCTTAC
CGCAAAGCCATCTTCATCTTTCTCAGCAATGCAGGCGGGGACCTTATAACTAAGACGGCTCTTGACTTTTGGCGG
GCCGGAAGAAAGAGGGAAGACATTCAGCTGAAGGACCTGGAACCTGTACTGTCTGTCGGAGTCTTCAATAATAAA
CACAGTGGCCTGTGGCACAGTGGACTGATCGACAAAAACCTCATTGATTACTTTATCCCCTTCCTGCCTTTGGAG
TACAGACATGTGAAAATGTGTGTGAGGGCCGAGATGAGGGCCCGTGGTTCTGCCATAGATGAAGACATTGTCACA
AGAGTGGCAGAGGAAATGACGTTTTTCCCCAGAGACGAGAAAATCTACTCAGACAAGGGCTGCAAGACTGTGCAG
TCGCGGCTGGATTTCCACTGAGCTCCTATCCAGATGGGGTAGGAGACAGCTGGGAGGCTCCGCACGCCAGAGGCC
TTGCCTTTCAGAAGAACCCTGAAGACCGCTTTGGGGTTTTGCCTGTTTGCACCTTAGACTTTTGGGTATAGAATC
TTTTTTTTGAGAAGAGGTCTCACTCCGTCATCCAAGCTGGAGTGCAGTGGTGCAATCCTCAACTCACTGCAACCT
CCGCTCCCGGTTTGAGTGATTCTCATGCCTCAGCCTCCCGAGTAGCTGGGATTACAGGCATGAGCCACTGTGCCC
AGCTGGGATATAGAATCTAAGAGTTGATTGTGGAAAACACGTGAATCTATTGCGCGCATTTGTCATTTAGCAAGA
TGGCAGCAGTCCAGCTGTTCTTTGCAGCTGGAGATGAACTTTTAAAAATCCCCTTCACACTTAATGTACTGACCG
AGACAGAAGTACCTGAAAACAGCTGTGCATGGCAGGCCCGGCAATAGCTTCTGACCCACAGCACCCGCGCCTCAG
AAGCTACGGTCACAACTAAAGGAGTCCAGGGACTTGCTGCAGGCTGGGGGGCACTGGGTGGTTCTCACCAGCAGG
CTGCGGGGCACTGTGTTCTCATTGGCCAAAAACATCCTTTTGCTCTGTCTCGTTCTTTACACAGAGTTCACTGAC
TTGAAGTATACTCAGTTAAAATCGGGGCTGGAGGTGCAGACGGTGTCTGACCGGAGGATGTGGCCGTGCCCGCCG
AGCACTCTTGATCTGAGCTGACCTGTGTGTGTGTGGGGGGGGGTGGGGCCTTCACCTAAGACCTCTGCAGCAG
ACCTGGACAGACAGGCCCCTCCCGCCTGTCCATCGCTCTAGCTGCTAATACAGCCCTGGCTGTGGAATCCTTCAC
CGTCTCAGCTGGTATCAGCCCCAGCCTGCCTTGTGCCATATCTCAGCTTGGATCTCTGCTAGAGTCCCCCCAACC
ATATATCATAGAGTTGAATCACAATGAGACCGTTGGCTTTGAATTTGAGTCGTTGGTTCCCATGGTGAGATGCTT
GTTAAGACTTTATACTTGGGTCAATCTCTCACTTTATTTTGTAGAACCATTTGAAATCCTAGGATGTGCTTGTTC
TGGAAGGATGACATGGGCCCAGACTGAACAAGTCAGCTTGATGATCTTAAATGATGGAAGTATAGGACGTTGCTT
ATTTAAAACAAGGGAAGGACACAAAATGGAATGACTGCTTAGTCCTTTCTCAGATACTCTTAAAACAATTTTTT
ATTGTTAAATTTGTGGTAATACATGGTCACAACCGTGGATCAAACAAGGTCAGTCTAAAGTGGCAGGTCCTAGGT
GTGACCTGATACCACCACCCTTTGTGGCAGCACCGGGCTGGACTGCCCTGATCCCTGGGACGTGAGACTTAGCTT
CCAGCCAGTGTGAATCATTGTATCTGTCTCATAATCACAGCACAGCTGCAGACACAACAACGTGCAGCATTTTTT
ACATAAAAATATGGTAGAATTAATTTATGACATGGAAATGCCTTACGTGGTATCACACTTAGTCTTGAAAAAAAC
ACCAAGGTGACGTTTAAAATTTTTAGTACATATCCTCAAATTGGAGCTAAGTTATACTTCTTTTATAACCTTTTG
GGCATCTGGTCGAGAGAAGACAAGATTTTCTCTATTTACAGTGAGGCAATAAATATGTTTGCCACCTTTAAAAA
```

FIGURE 292

MLRAGWLRGAAALALLLAARVVAAFEPITVGLAIGAASAITGYLSYNDIYCRFAECCREERPLNASALKLDLEEK
LFGQHLATEVIFKALTGFRNNKNPKKPLTLSLHGWAGTGKNFVSQIVAENLHPKGLKSNFVHLFVSTLHFPHEQK
IKLYQDQLQKWIRGNVSACANSVFIFDEMDKLHPGIIDAIKPFLDYYEQVDGVSYRKAIFIFLSNAGGDLITKTA
LDFWRAGRKREDIQLKDLEPVLSVGVFNNKHSGLWHSGLIDKNLIDYFIPFLPLEYRHVKMCVRAEMRARGSAID
EDIVTRVAEEMTFFPRDEKIYSDKGCKTVQSRLDFH

FIGURE 293

```
GCGGAGTCTCCAACTGGGAGAGCTGCAGCTGCCGAGAGGAGGAGAACGCTGAGGTCGGTCGGACCAACGGACGCG
CTGACCGCTGCCAACTGCAGCTCGCGCTGCCTCCTGCTCGCGCCGTGCCACTAAGGTCACTCCCGCCTCCGAGAG
CCCAGAGCCGAGATGGAAACGGTCCAGGAGCTGATCCCCTGGCCAAGGAGATGATGGCCCAGAAGCGCAAGGGG
AAGATGGTGAAGCTGTACGTGCTGGGCAGCGTGCTGGCCCTCTTCGGCGTGGTGCTCGGCCTGATGGAGACTGTG
TGCAGCCCCTTCACGGCCGCCAGACGTCTGCGGGACCAGGAGGCAGCCGTGGCGGAGCTGCAGGCCGCCCTGGAG
CGACAGGCTCTCCAGAAGCAAGCCCTGCAGGAGAAAGGCAAGCAGCAGGACACGGTCCTCGGCGGCCGGGCCCTG
TCCAACCGGCAGCACGCCTCCTAGGAACTGTGGGAGACCAGCGGAGTGGGAGGGAGACGCAGTAGACAGAGACAG
ACCGAGAAGGAAGGGAGAGACAGAGGGGGCGCGCGCACAGGAGCCTGACTCCGCTGGGAGAGTGCAGGAGCACGT
GCTGTTTTTATTTGGACTTAACTTCAGAGAAACCGCTGACATCTAGAACTGACCTACCACAAGCATCCACCAAA
GGAGTTTGGGATTGAGTTTGCTGCTGTGCAGCACTGCATTGTCATGACATTTCCAACACTGTGTGAATTATCTA
AATGCGTCTACCATTTTGCACTAGGGAGGAAGGATAAATGCTTTTTATGTTATTATTATTAATTATTACAATGAC
CACCATTTTGCATTTGAAATAAAAAACTTTTTATACCAAAAAAAAAAAAAAAA
```

FIGURE 294

METVQELIPLAKEMMAQKRKGKMVKLYVLGSVLALFGVVLGLMETVCSPFTAARRLRDQEAAVAELQAALERQAL
QKQALQEKGKQQDTVLGGRALSNRQHAS

FIGURE 295

GCCCTCTAGGGTAGAATCGCCAAGCTTTGAGAGAAGGCTGTGACTGCTGTGCTCTGGGCGCCAGCTCGCTCCAGG
GAGTGATGGGAATCCTGTCATTCTTACCTGTCCTTGCCACTGAGAGTGACTGGGCTGACTGCAAGTCCCCCCAGC
CTTGGGGTCATATGCTTCTGTGGACAGCTGTGCTATTCCTGGCAGCTCCCCCAAAGGCTGTGCTGAAACTCGAGC
CCCAGTGGATCAACGTGCTCCAGGAGGACTCTGTGACTCTGACATGCCGGGGGACTCACAGCCCTGAGAGCGACT
CCATTCAGTGGTTCCACAATGGGAATCTCATTCCCACCCACACGCAGCCCAGCTACAGGTTCAAGGCCAACAACA
ATGACAGCGGGGAGTACACGTGCCAGACTGGCCAGACCAGCCTCAGCGACCCTGTGCATCTGACTGTGCTTTCTG
AGTGGCTGGTGCTCCAGACCCCTCACCTGGAGTTCCAGGAGGGAGAAACCATCGTGCTGAGGTGCCACAGCTGGA
AGGACAAGCCTCTGGTCAAGGTCACATTCTTCCAGAATGGAAAATCCAAGAAATTTTCCCGTTCGGATCCCAACT
TCTCCATCCCACAAGCAAACCACAGTCACAGTGGTGATTACCACTGCACAGGAAACATAGGCTACACGCTGTTCT
CATCCAAGCCTGTGACCATCACTGTCCAAGCTCCCAGCTCTTCACCGATGGGGATCATTGTGGCTGTGGTCACTG
GGATTGCTGTAGCGGCCATTGTTGCTGCTGTAGTGGCCTTGATCTACTGCAGGAAAAAGCGGATTTCAGCTCTCC
CAGGATACCCTGAGTGCAGGGAAATGGGAGAGACCCTCCCTGAGAAACCAGCCAATCCCACTAATCCTGATGAGG
CTGACAAAGTTGGGGCTGAGAACACAATCACCTATTCACTTCTCATGCACCCGGATGCTCTGGAAGAGCCTGATG
ACCAGAACCGTATTTAGTCTCCATTGTCTTGCATTGGGATTTGAAGAAGAAAATCAGAGAGGGAAGATCTGGTATT
TCCTGGCCTAAATTCCCCTTGGAGGACAGGGAGATGCTCGAGTTCCAAAAGAGAAGGTTTCTTCCAGAGTCATCT
ACCTGAGTCCTGAAGCTCCCTGTCCTGAAAGCCACAGACAATATGGTCCCAAATAACCGACTGCACCTGCTGTCT
TCAGCTCTTCTTGACATCAAGGCTCTTCCGTTCCACATCCACACAGCCAATCCAATTAATCAAACCACTGTTATT
AACAGATAATAGCAACTTGGGAAATGCTTATGTTACAGGTTACCGTTGAGAACAATCATCTAAATCTATATGATT
TCAGAAATGTTAAAATAGACTAACCTCTACCAGCACATTAAAAGTGATTGTTTCTGGGTGATTTATTGATGATTT
TTATTTTCTTTATTTTTCTATAAAGATCATATATTACTTTT

FIGURE 296

MGILSFLPVLATESDWADCKSPQPWGHMLLWTAVLFLAAPPKAVLKLEPQWINVLQEDSVTLTCRGTHSPESDSI
QWFHNGNLIPTHTQPSYRFKANNNDSGEYTCQTGQTSLSDPVHLTVLSEWLVLQTPHLEFQEGETIVLRCHSWKD
KPLVKVTFFQNGKSKKFSRSDPNFSIPQANHSHSGDYHCTGNIGYTLFSSKPVTITVQAPSSSPMGIIVAVVTGI
AVAAIVAAVVALIYCRKKRISALPGYPECREMGETLPEKPANPTNPDEADKVGAENTITYSLLMHPDALEEPDDQ
NRI

FIGURE 297A

```
CTCGAGGCTCCGCACCAGCCGCGCTTCTGTCCGCCTGCAGGGCATTCCAGAAAGATGAGGATATTTGCTGTCTTT
ATATTCATGACCTACTGGCATTTGCTGAACGCATTTACTGTCACGGTTCCCAAGGACCTATATGTGGTAGAGTAT
GGTAGCAATATGACAATTGAATGCAAATTCCCAGTAGAAAAACAATTAGACCTGGCTGCACTAATTGTCTATTGG
GAAATGGAGGATAAGAACATTATTCAATTTGTGCATGGAGAGGAAGACCTGAAGGTTCAGCATAGTAGCTACAGA
CAGAGGGCCCGGCTGTTGAAGGACCAGCTCTCCCTGGGAAATGCTGCACTTCAGATCACAGATGTGAAATTGCAG
GATGCAGGGGTGTACCGCTGCATGATCAGCTATGGTGGTGCCGACTACAAGCGAATTACTGTGAAAGTCAATGCC
CCATACAACAAAATCAACCAAAGAATTTTGGTTGTGGATCCAGTCACCTCTGAACATGAACTGACATGTCAGGCT
GAGGGCTACCCCAAGGCCGAAGTCATCTGGACAAGCAGTGACCATCAAGTCCTGAGTGGTAAGACCACCACCACC
AATTCCAAGAGAGAGGAGAAGCTTTTCAATGTGACCAGCACACTGAGAATCAACACAACAACTAATGAGATTTTC
TACTGCACTTTTAGGAGATTAGATCCTGAGGAAAACCATACAGCTGAATTGGTCATCCCAGAACTACCTCTGGCA
CATCCTCCAAATGAAAGGACTCACTTGGTAATTCTGGGAGCCATCTTATTATGCCTTGGTGTAGCACTGACATTC
ATCTTCCGTTTAAGAAAAGGGAGAATGATGGATGTGAAAAAATGTGGCATCCAAGATACAAACTCAAAGAAGCAA
AGTGATACACATTTGGAGGAGACGTAATCCAGCATTGGAACTTCTGATCTTCAAGCAGGGATTCTCAACCTGTGG
TTTAGGGGTTCATCGGGCTGAGCGTGACAAGAGGAAGGAATGGACCCGTGGGATGCAGGCAATGTGGGACTTAA
AAGGCCCAAGCACTGAAAATGGAACCTGGCGAAAGCAGAGGAGGAGAATGAAGAAAGATGGAGTCAAACAGGGAG
CCTGGAGGGAGACCTTGATACTTTCAAATGCCTGAGGGGCTCATCGACGCCTGTGACAGGGAGAAAGGATACTTC
TGAACAAGGAGCCTCCAAGCAAATCATCCATTGCTCATCCTAGGAAGACGGGTTGAGAATCCCTAATTTGAGGGT
CAGTTCCTGCAGAAGTGCCCTTTGCCTCCACTCAATGCCTCAATTTCTTTTCTGCATGACTGAGAGTCTCAGTGT
TGGAACGGGACAGTATTTATGTATGAGTTTTTCCTATTTATTTTGAGTCTGTGAGGTCTTCTTGTCATGTGAGTG
TGGTTGTGAATGATTTCTTTTGAAGATATATTGTAGTAGATGTTACAATTTTGTCGCCAAACTAAACTTGCTGCT
TAATGATTTGCTCACATCTAGTAAAACATGGAGTATTTGTAAGGTGCTTGGTCTCCTCTATAACTACAAGTATAC
ATTGGAAGCATAAAGATCAAACCGTTGGTTGCATAGGATGTCACCTTTATTTAACCCATTAATACTCTGGTTGAC
CTAATCTTATTCTCAGACCTCAAGTGTCTGTGCAGTATCTGTTCCATTTAAATATCAGCTTTACAATTATGTGGT
AGCCTACACACATAATCTCATTTCATCGCTGTAACCACCCTGTTGTGATAACCACTATTATTTTACCCATCGTAC
AGCTGAGGAAGCAAACAGATTAAGTAACTTGCCCAAACCAGTAAATAGCAGACCTCAGACTGCCACCCACTGTCC
TTTTATAATACAATTTACAGCTATATTTACTTTAAGCAATTCTTTTATTCAAAAACCATTTATTAAGTGCCCTT
GCAATATCAATCGCTGTGCCAGGGCATTGAATCTACAGATGTGAGGCAAGACAAAGTACCTGTCCTCAAGGAGCT
CATAGTATAATGAGGAGATTAACAAGAAAATGTATTATTACAATTTAGTCCAGTGTCATAGCATAAGGATGATGC
GAGGGGAAAACCCGAGCAGTGTTGCCAAGAGGAGGAAATAGGCCAATGTGGTCTGGGACGGTTGGATATACTTAA
ACATCTTAATAATCAGAGTAATTTTCATTTACAAAGAGAGGTCGGTACTTAAAATAACCCTGAAAAATAACACTG
GAATTCCTTTTCTAGCATTATATTTATTCCTGATTTGCCTTTGCCATATAATCTAATGCTTGTTTATATAGTGTC
TGGTATTGTTAACAGTTCTGTCTTTCTATTTAAATGCCACTAAATTTTAAATTCATACCTTTCCATGATTCAA
AATTCAAAAGATCCCATGGGAGATGGTTGGAAAATCTCCACTTCATCCTCCAAGCCATTCAAGTTTCCTTTCCAG
AAGCAACTGCTACTGCCTTTCATTCATATGTTCTTCTAAAGATAGTCTACATTTGGAAATGTATGTTAAAAGCAC
GTATTTTAAAATTTTTTTCCTAAATAGTAACACATTGTATGTCTGCTGTGTACTTTGCTATTTTATTTATTTT
AGTGTTCTTATATAGCAGATGGAATGAATTTGAAGTTCCCAGGGCTGAGGATCCATGCCTTCTTTGTTTCTAAG
TTATCTTTCCCATAGCTTTTCATTATCTTTCATATGATCCAGTATATGTTAAATATGTCCTACATATACATTTAG
ACAACCACCATTTGTTAAGTATTTGCTCTAGGACAGAGTTTGGATTTGTTTATGTTTGCTCAAAAGGAGACCCAT
GGGCTCTCCAGGGTGCACTGAGTCAATCTAGTCCTAAAAAGCAATCTTATTATTAACTCTGTATGACAGAATCAT
GTCTGGAACTTTTGTTTCTGCTTTCTGTCAAGTATAAACTTCACTTTGATGCTGTACTTGCAAAATCACATTTT
CTTTCTGGAAATTCCGGCAGTGTACCTTGACTGCTAGCTACCCTGTGCCAGAAAAGCCTCATTCGTTGTGCTTGA
ACCCTTGAATGCCACCAGCTGTCATCACTACACAGCCCTCCTAAGAGGCTTCCTGGAGGTTTCGAGATTCAGATG
CCCTGGGAGATCCCAGAGTTTCCTTTCCCTCTTGGCCATATTCTGGTGTCAATGACAAGGAGTACCTTGGCTTTG
CCACATGTCAAGGCTGAAGAAACAGTGTCTCCAACAGAGCTCCTTGTGTTATCTGTTTGTACATGTGCATTTGTA
CAGTAATTGGTGTGACAGTGTTCTTTGTGTGAATTACAGGCAAGAATTGTGGCTGAGCAAGGCACATAGTCTACT
CAGTCTATTCCTAAGTCCTAACTCCTCCTTGTGGTGTTGGATTTGTAAGGCACTTTATCCCTTTTGTCTCATGTT
TCATCGTAAATGGCATAGGCAGAGATGATACCTAATTCTGCATTTGATTGTCACTTTTGTACCTGCATTAATTT
AATAAAATATTCTTATTTATTTTGTTACTTGGTACACCAGCATGTCCATTTTCTTGTTTATTTTGTGTTTAATAA
```

FIGURE 297B

AATGTTCAGTTTAACATCCCAGTGGAGAAAGTTAAAAAA

FIGURE 298

LEAPHQPRFCPPAGHSRKMRIFAVFIFMTYWHLLNAFTVTVPKDLYVVEYGSNMTIECKFPVEKQLDLAALIVYW
EMEDKNIIQFVHGEEDLKVQHSSYRQRARLLKDQLSLGNAALQITDVKLQDAGVYRCMISYGGADYKRITVKVNA
PYNKINQRILVVDPVTSEHELTCQAEGYPKAEVIWTSSDHQVLSGKTTTTNSKREEKLFNVTSTLRINTTTNEIF
YCTFRRLDPEENHTAELVIPELPLAHPPNERTHLVILGAILLCLGVALTFIFRLRKGRMMDVKKCGIQDTNSKKQ
SDTHLEET

FIGURE 299

```
CCGAGCGGGCTGGGGGAGGGGAGCGTGGGGCCGACAGTTTTGGGGGTGAAAAGGCAAAAGGCGGGTGAAAGGCTG
CCTCCCGAGACTCTCCTTGCTTGGAATTCTGCCCACTCTGCGGAGTTAGCAGTCACGACCTCCAGCACAGGATGT
GGTACCACAGATTGTCCCACCTACACAGCAGGCTTCAGGACTTGCTGAAGGGAGGAGTCATATATCCGGCCCTTC
CACAGCCCAACTTCAAAAGCTTACTTCCTTTAGCTGTCCATTGGCACCATACAGCCTCCAAGTCTCTGACTTGTG
CTTGGCAGCAACATGAAGATCATTTTGAGCTGAAATATGCTAATACCGTGATGCGCTTTGATTACGTCTGGCTTC
GAGACCACTGCCGCTCAGCATCGTGCTACAACTCTAAGACTCACCAGCGCAGCCTGGATACTGCCAGTGTGGATT
TATGTATCAAGCCAAAGACCATTCGTCTGGATGAGACCACACTCTTTTTCACTTGGCCAGATGGTCATGTGACTA
AATATGATTTGAATTGGCTGGTGAAAAACAGCTATGAAGGGCAGAAACAAAAAGTCATCCAGCCTAGAATACTAT
GGAATGCTGAAATCTACCAGCAAGCCCAAGTTCCATCGGTAGATTGCCAGAGCTTCTTAGAAACCAACGAGGGAC
TGAAGAAGTTTCTGCAAAACTTTCTGCTCTATGGAATTGCATTCGTAGAAAATGTCCCTCCCACTCAAGAGCACA
CAGAGAAGTTGGCAGAAAGGATCAGCTTAATCAGAGAAACCATTTATGGGAGGATGTGGTATTTCACTTCAGACT
TCTCCAGAGGTGACACTGCGTACACCAAGCTAGCTCTGGATCGGCACACTGACACTACCTATTTTCAAGAGCCCT
GTGGCATTCAAGTGTTTCATTGTCTTAAACATGAAGGAACTGGTGGCAGGACACTGCTAGTAGATGGATTCTATG
CAGCAGAACAGGTACTTCAAAAGGCACCTGAGGAATTTGAACTCCTCAGTAAAGTGCCATTGAAGCATGAATATA
TTGAAGATGTTGGAGAATGTCACAACCACATGATTGGGATTGGGCCAGTCTTAAATATCTACCCATGGAATAAAG
AGCTGTATTTGATCAGGTACAACAACTATGACCGGGCTGTCATCAATACCGTTCCTTATGATGTCGTCCATCGCT
GGTATACAGCACACCGGACTCTAACGATAGAGTTGAGGAGACCTGAGAATGAGTTTTGGGTCAAACTAAAGCCTG
GCAGGGTCCTATTTATAGACAACTGGCGTGTCCTACATGGCAGGGAATGCTTCACTGGCTACCGCCAACTGTGTG
GCTGCTATTTAACAAGAGATGATGTATTAAACACTGCTCGCCTCTTGGGGCTTCAGGCTTAAAATTGACAGCATC
TGGATTATGAATACACCTGGCACCCTGGCTACCAGAATTTCATATGGGCAGAATAATATTGTGTCAAACTCTACT
TCAGATTGTCTCCTTATCCCATCCCACAAAACAGAATCTGTCCGTTTCTCTAGTAAGGGAGACTTGTTGGAGAGG
CGGGACTCTGAGTTATCTAATGTCAGACATCTAGTGGGGCAGCTCTCTTCCTCATGTTATAACATGGATCCACTT
GTTTTATTTAAACCTTTTAATATAATTTTGGTCAGTCTCCTTCAGAAATATAATCTCCATATTGATAGGAAAGCA
ATAATTGCCATGAGGTAACGATTTTTTTCCCAAGTAGATCAGTTAGAAAGAAATGCATTCTAGAAATAACAAAAA
TCCTGATAAAGCAACAATTTGCAAAATGTTTGGTCTTAGGACACCTTAACACTCTTAAAAGTTATTGAAGGCCCC
AAGGAGTTCTTGGGTGTGGGTTCTATCTATTGATACTAATTATTTTAGGTATTAAGACTGAGAAATATTTAAAGC
TCAAGAAGAACACAGAAGCACACATCCCTCAGCTATGAGAGAGATGACATAACCATATGTCATGTAGCCTCTGGA
AAAGTCCTCTGTATCCTCATGAGATAACGAGAGGGGGAAAAAAAGCTACTACTGCCTTTGTAACTTCCACTTAGC
CTACTACAGGGCTATGCACATCTTAGTTTCCAAAAGTCTGCTTAATTTCAAAAGAAAAATGCCTAATTGAATGTA
ACTCATCTTGGTGTTATTATACAAAATAATTTTTAATCTGCAGACCCACGAAAAGGGTCTCAGGGACTCCTCCAG
GGGTCTTCAGACCATACTTTGAGAACCCATGGGCTAGCGACTACCTTGAGACAGTCCTTTACCTAGGCCTGTGGA
TTAAAGGGTTTAGCTGAAACCCTAGATTCTTCTCTGTAGTCTAATAGAACTCCAAACATTGTAAGAATTGCTTGG
TAGCATAAGCTCAGGGATAAGGTGGGAATTGAGTTCAAATATAGTGTTTTATCTTCCACACAAATCATCTCTATA
GGAGTTAAATTAGGAAGTCACAACAGCGCCTGTTGAACAAACTCATCAGTGTGGTAATCCTATGAGGGATAATTG
CAGAAAGGTTTTAGAGACTTGTGAGGTTCCATATGATAATTCTTTACACCTCCCCCCCCCAAGAGAAAGTACACA
GGGCTATTCTGTAATATTGTTCAGGGAAATCAGCATGATAGATGCTGTGCCTCCAGAGAGTTCTCTGGAGATTAC
TACCCAAATGTGTATTTTGGCAATTTGGTGGTATTTAGGATGTAATATGTTTTCCTCCATTTCTGCTAATTTTCT
CTCTCTCTCTCATAACATACTATACATGCTAATTGCCAAGATTTGAATGAGTCAAATTT
```

FIGURE 300

MWYHRLSHLHSRLQDLLKGGVIYPALPQPNFKSLLPLAVHWHHTASKSLTCAWQQHEDHFELKYANTVMRFDYVW
LRDHCRSASCYNSKTHQRSLDTASVDLCIKPKTIRLDETTLFFTWPDGHVTKYDLNWLVKNSYEGQKQKVIQPRI
LWNAEIYQQAQVPSVDCQSFLETNEGLKKFLQNFLLYGIAFVENVPPTQEHTEKLAERISLIRETIYGRMWYFTS
DFSRGDTAYTKLALDRHTDTTYFQEPCGIQVFHCLKHEGTGGRTLLVDGFYAAEQVLQKAPEEFELLSKVPLKHE
YIEDVGECHNHMIGIGPVLNIYPWNKELYLIRYNNYDRAVINTVPYDVVHRWYTAHRTLTIELRRPENEFWVKLK
PGRVLFIDNWRVLHGRECFTGYRQLCGCYLTRDDVLNTARLLGLQA

FIGURE 301A

GAATCTTTCCATGCCGCTGGAGCTCATCTGCTCCGATGAGCACATGCAAGGCAGCGGGAGCCTGGCCCAGGCTGT
CATCAGGGAAGTCAGAGCCCAGTGGAGTCGGATTTTCTCCACCGCACTCTTCGTGGAGCACGTGCTCCTAGGAAC
CGAGAGCCGCGTCCCCGAGTTACAGGGGCTGGTGACCGAGCACGTCTTCTTACTAGACAAGTGTCTTCGAGAGAA
CTCTGACGTGAAGACGCACGGGCCTTTTGAGGCCGTGATGCGCACTCTCTGTGAATGCAAGGAGACAGCCAGCAA
GACCCTCAGCAGGTTTGGGATTCAGCCGTGCTCCATCTGCCTGGGAGATGCAAAGGACCCCGTCTGTCTGCCCTG
CGACCACGTGCACTGCCTGCGCTGCCTCAGGGCCTGGTTTGCCTCAGAGCAGATGATATGCCCCTACTGTTTAAC
TGCCTTGCCAGACGAATTCTCTCCAGCTGTTTCCCAAGCGCACAGGGAAGCCATTGAAAAGCATGCCCGCTTCCG
GCAGATGTGCAACAGTTTCTTCGTAGACCTGGTGTCCACCATTTGCTTCAAGGACAACGCTCCGCCTGAGAAGGA
AGTGATTGAGAGCCTGCTCTCTCTCCTCTTCGTCCAAAAGGGGCGCTTAAGAGATGCTGCCCAGAGACACTGTGA
ACACACAAAATCTCTCTCTCCATTCAATGATGTTGTGGATAAGACTCCTGTCATCCGCTCAGTGATACTGAAACT
GCTTTTGAAGTACAGCTTTCATGATGTAAAAGATTATATTCAGGAATATTTGACCCTGTTAAAAAAGAAAGCATT
CATAACTGAAGATAAAACTGAACTGTACATGCTCTTCATCAACTGCCTGGAGGATTCAATACTTGAGAAGACCAG
TGCTTACTCCAGAAATGATGAACTGAACCACCTAGAAGAGGAAGGTCGTTTCCTTAAGGCATATTCTCCAGCAAG
CCGGGGCCGAGAGCCTGCCAACGAGGCCTCGGTTGAATACCTGCAAGAGGTGGCCCGGATCCGCCTCTGCCTCGA
CAGAGCTGCAGATTTCCTCTCGGAGCCTGAGGGAGGCCCAGAGATGGCCAAGGAGAAGCAGTGCTACCTGCAGCA
AGTCAAGCAGTTCTGTATCCGGGTGGAGAACGACTGGCACCGGGTGTACCTGGTGCGGAAGCTCAGCAGCCAGCG
GGGGATGGAGTTCGTGCAGGGCCTCTCCAAGCCCGGCCGCCCGCACCAGTGGGTGTTTCCCAAGGACGTTGTCAA
GCAGCAGGGGCTGCGGCAGGACCACCCAGGCCAGATGGATAGGTACCTGGTGTACGGCGATGAATACAAGGCTCT
CCGTGATGCTGTGGCCAAAGCTGTCCTCGAGTGCAAGCCACTGGGCATTAAGACTGCTCTGAAGGCCTGCAAGAC
CCCCCAAAGCCAGCAGTCAGCCTACTTCCTGTTAACACTGTTTAGAGAGGTGGCTATTTTGTACAGATCCCACAA
TGCAAGCCTCCACCCCACGCCAGAGCAATGTGAAGCTGTGAGCAAATTCATTGGCGAATGCAAGATCCTTTCACC
TCCTGATATCAGCCGTTTTGCAACATCGCTCGTGGACAATTCTGTGCCATTGTTGAGGGCGGGGCCTAGTGACAG
CAACCTTGATGGAACGGTGACAGAAATGGCCATTCATGCTGCAGCCGTCCTTCTGTGTGGACAGAATGAACTCTT
GGAGCCCCTAAAGAATCTGGCCTTCTCCCCAGCCACCATGGCGCATGCTTTTCTTCCAACCATGCCTGAAGACTT
GCTGGCTCAAGCTCGGAGGTGGAAGGGTCTGGAGCGAGTCCACTGGTACACTTGTCCCAACGGCCATCCTTGCTC
CGTGGGAGAGTGTGGCAGGCCGATGGAACAGAGCATCTGCATTGACTGCCATGCGCCGATTGGAGGCATTGACCA
CAAACCTCGGGACGGCTTTCATCTGGTCAAAGACAAGGCAGACAGAACGCAGACCGGCCATGTGCTGGGCAACCC
GCAGCGGAGAGACGTGGTGACATGTGACCGAGGGCTGCCCCCAGTGGTCTTCCTCCTTATCCGGCTACTCACTCA
CTTGGCTCTGCTTCTGGGAGCGTCCCAGAGTTCCCAGGCTCTGATAAACATCATTAAGCCTCCAGTGAGGGATCC
AAAAGGCTTTCTGCAGCAGCACATCCTGAAGGACCTGGAGCAGTTGGCCAAGATGCTGGGACACAGTGCCGACGA
GACCATCGGCGTGGTCCACCTCGTCCTGCGCAGGCTTCTCCAAGAGCAGCACCAGCTCTCTAGCAGAAGGCTTTT
AAATTTTGACACAGAATTGTCAACTAAAGAAATGAGGAACAACTGGGAAAAGGAAATCGCAGCTGTGATTTCTCC
TGAACTGGAGCATCTAGATAAAACCCTTCCCACCATGAATAATCTCATCAGCCAAGATAAGCGTATCAGCTCTAA
CCCTGTGGCCAAAATAATATATGGTGACCCAGTGACCTTCCTGCCCCACCTGCCCCGGAAAAGTGTGGTCCATTG
CTCTAAGATTTGGAGCTGCAGGAAAAGAATTACAGTTGAGTACCTCCAGCACATTGTGGAACAGAAAAATGGCAA
AGAAAGAGTGCCCATCCTCTGGCATTTCCTGCAGAAGGAAGCAGAGCTGAGGCTGGTAAAGTTCCTGCCTGAGAT
TTTGGCCTTGCAAAGGGATCTAGTGAAGCAGTTCCAGAACGTCCAGCAAGTTGAATACAGCTCCATCAGAGGCTT
CCTCAGCAAGCACAGCTCAGATGGGTTGAGGCAGCTGCTTCACAACAGGATCACAGTCTTTCTGTCCACATGGAA
CAAACTGAGGAGATCGCTTGAGACGAACGGTGAGATCAACCTACCCAAAGACTACTGCAGCACTGACTGGATCT
GGACACTGAGTTTGAGATCCTCTTGCCACGCCGACGGGCCTGGGCCTCTGTGCTACCGCTCTCGTCAGCTACTT
GATTCGCCTACACAATGAAATTGTCTACGCCGTGGAAAAACTCTCCAAGGAAAACAACAGCTATTCCGTGGATGC
CGCCGAGGTCACTGAACTGCATGTCATCAGTTATGAAGTGGAGCGGGACCTGACTCCACTGATTCTCTCCAACTG
CCAGTACCAGGTGGAGGAGGGCAGAGAGACCGTGCAGGAGTTCGATCTGGAGAAGATTCAGCGGCAGATCGTCAG
CCGCTTCCTCCAGGGCAAGCCCCGGCTGAGCCTCAAGGGAATACCCACTCTGGTGTACAGACACGACTGGAACTA
TGAACATCTCTTTATGGACATCAAGAACAAAATGGCACAGGACTCCCTCCCCAGCTCGGTCATTAGTGCCATCAG
TGGACAGCTGCAGTCCTACAGCGATGCCTGTGAAGTGCTGTCTGTCGTAGAAGTCACTCTGGGGTTTCTGAGCAC
AGCTGGTGGGGATCCAAACATGCAGCTGAATGTGTATACTCAAGACATCCTGCAAATGGGTGATCAGACGATTCA
CGTGTTAAAGGCCTTAAACAGATGCCAGTTAAAAACACACCATTGCCCTCTGGCAGTTCCTGTCTGCTCATAAGTC

FIGURE 301B

```
TGAACAGCTGCTGCGGCTGCACAAAGAGCCATTTGGGGAAATCAGTTCAAGGTACAAAGCGGATCTGAGCCCGGA
AAATGCTAAGCTCCTCAGCACATTCCTAAATCAGACTGGCCTAGACGCCTTCCTGCTAGAGCTGCACGAAATGAT
AATCTTGAAACTAAAGAACCCCCAAACCCAAACCGAGGAGCGCTTCCGCCCTCAGTGGAGCCTGAGAGACACTCT
CGTAAGTTACATGCAAACTAAAGAAAGTGAAATTCTTCCTGAAATGGCATCTCAGTTCCCAGAAGAGATACTGCT
CGCCAGCTGTGTCTCAGTGTGGAAAACAGCTGCTGTGCTGAAATGGAATCGAGAAATGAGATAGAATTATTTCCT
CAGCTATCTTTGGATGACTTTGGAGAGAAGACTCCTCTCCTCGTCTGCGGCGTGGACTTGATCATGGACTGGT
GCCTTTGCATTCAGAAGGAGAGCTGTCAGCGTAGCACCGAATTCAAGACCAAGGCGTGCTACCTGAGCTGACAGC
TTTTTGAAAGCCGAGCTGTTTCTGAACCATGTACATACATGTTCTGAAACTTTCTCATCATTTTATGAGTACTGT
TCATTGAGAGATGACAATGAAGATTAGATGAAATTGGAAATAAACCAACATTGTTTACATTCCAGGAGACTTGTA
GCTCAGCCACACACGCAGTAATGACCTGTGCCCGTTCGCCTCTGGCACTGCCCACCCCTCTTTTTTTTTTTCTTC
TAATTCTGTACTCACAAAGAGAATCTCATTTTCTTCTTTCTTCCATTCCCTTAAATTCTGAGTACTGTACATAT
ATTTCTGGGTTCCCACGATGATGTGAAAAACTACCAGACTGTTTTTGTCTTCTCACAAAGACAAGAAAAATCAG
GGCATTTGTGAGTGCCTTAAGATCAAACTAACAAGATCTGACCCTCTCCCCTCACAGTGAGCCACTGCCCCACT
TCAGAGGGTAAGAGCCAAAAGCCTCATTGTGAAAGGCACTGGACTTGGACCAGGGACACCATCAGGGCCTTGGTT
TTCTCACGCATAAAATGGAGAGTGGATTAATCGCCAAAGATTCTTCTGATCTGACATTTTGAAATTGTGAGAGAA
ACTAGATGACTGTAAACTTGGTCACAGGCCTGGTTCTGGCAGTTCTTTGCGGACTTTTTCTAGCATTATGCCAA
ATAAACATGCAGTCTCAGTGTGCTCTCGCATGTATGAATATCTAGTCCTTTCTGTGGTTCTCAGCCAAGCACATAA
AAACTAGGACTCAGAGCACATACAAAACCAGTTATGTTTCGGAAAGAGGGAAAAGAGTCCCCGAGCCCGGATCTT
GTGCTGCTTTTCTCACTGACGTGTTGCCTTTTTCTTTACAAAATCTGCTTTGATACTTAGGACCTCTCTGGACT
AATTTCTCTTCCTAGACAGCTCAGCACAGCTATTGATATGTTAGAGGCAGTATCCTTAATATTCATTCTAAATGA
GTTAACGACTTAACTTGAAATTGGGCCTAAGGAGTGAGAACTACAAAAATACAAAATGCTTGTCCAGGACTCAGC
CATGCACACCTTGAGCAGCGCCGGCAGGAGGCACGGAAGGAACTGTGCTCCGTTCTCCTCACTGTCATGGTGCCA
CCAGTGTCTGATGAAGGGCAGAGTGACCCAGACTGCAGGCAGTAACTGACTTCACACAGTCCCTGGCATTTAGTC
ATCTGTGATTGTTTTATCACTCTGGACTGTGCAGAGCCACCTGCCACCGAGATCTGCATTCCGACTGCCTATGAA
CGGGTGTGGGGCCGGGGCTGGCTTGCTGAAGTCTTCAACTTGCACTCGGAGCTCCTTTGATACCTCAGAGCTG
GCTGTCAGGTGGCAGCTCACACCCAGACTCACTGGCCACACCTCAGCAGGGGGGAGTCGAGTGTCAGTCTCTTT
CTGTGAAGGCTTTTTTTTCCTTTGGCCTGGGAATTTTTCCCATTTTTATGAAGGGGTTTTAAATTGTTTCATTT
TGTGTGCTGTGCTTCAAAGCCTTAACTGTCAAATCTTGCATTATCTTGTTTGTACAGAAATATACTGGCCTAGCA
GAGGC
```

FIGURE 302

NLSMPLELICSDEHMQGSGSLAQAVIREVRAQWSRIFSTALFVEHVLLGTESRVPELQGLVTEHVFLLDKCLREN
SDVKTHGPFEAVMRTLCECKETASKTLSRFGIQPCSICLGDAKDPVCLPCDHVHCLRCLRAWFASEQMICPYCLT
ALPDEFSPAVSQAHREAIEKHARFRQMCNSFFVDLVSTICFKDNAPPEKEVIESLLSLLFVQKGRLRDAAQRHCE
HTKSLSPFNDVVDKTPVIRSVILKLLLKYSFHDVKDYIQEYLTLLKKKAFITEDKTELYMLFINCLEDSILEKTS
AYSRNDELNHLEEEGRFLKAYSPASRGREPANEASVEYLQEVARIRLCLDRAADFLSEPEGGPEMAKEKQCYLQQ
VKQFCIRVENDWHRVYLVRKLSSQRGMEFVQGLSKPGRPHQWVFPKDVVKQQGLRQDHPGQMDRYLVYGDEYKAL
RDAVAKAVLECKPLGIKTALKACKTPQSQQSAYFLLTLFREVAILYRSHNASLHPTPEQCEAVSKFIGECKILSP
PDISRFATSLVDNSVPLLRAGPSDSNLDGTVTEMAIHAAAVLLCGQNELLEPLKNLAFSPATMAHAFLPTMPEDL
LAQARRWKGLERVHWYTCPNGHPCSVGECGRPMEQSICIDCHAPIGGIDHKPRDGFHLVKDKADRTQTGHVLGNP
QRRDVVTCDRGLPPVVFLLIRLLTHLALLLGASQSSQALINIIKPPVRDPKGFLQQHILKDLEQLAKMLGHSADE
TIGVVHLVLRRLLQEQHQLSSRRLLNFDTELSTKEMRNNWEKEIAAVISPELEHLDKTLPTMNNLISQDKRISSN
PVAKIIYGDPVTFLPHLPRKSVVHCSKIWSCRKRITVEYLQHIVEQKNGKERVPILWHFLQKEAELRLVKFLPEI
LALQRDLVKQFQNVQQVEYSSIRGFLSKHSSDGLRQLLHNRITVFLSTWNKLRRSLETNGEINLPKDYCSTDLDL
DTEFEILLPRRRGLGLCATALVSYLIRLHNEIVYAVEKLSKENNSYSVDAAEVTELHVISYEVERDLTPLILSNC
QYQVEEGRETVQEFDLEKIQRQIVSRFLQGKPRLSLKGIPTLVYRHDWNYEHLFMDIKNKMAQDSLPSSVISAIS
GQLQSYSDACEVLSVVEVTLGFLSTAGGDPNMQLNVYTQDILQMGDQTIHVLKALNRCQLKHTIALWQFLSAHKS
EQLLRLHKEPFGEISSRYKADLSPENAKLLSTFLNQTGLDAFLLELHEMIILKLKNPQTQTEERFRPQWSLRDTL
VSYMQTKESEILPEMASQFPEEILLASCVSVWKTAAVLKWNREMR

FIGURE 303

```
GCAGAGCCCAGGGAGCTGGAGGTCGGCGCTTCCTCTCGTGCTTGGTCCACTGACGCGCGGCCCCGCCGCGAGGAG
CATCAGATCCATGCTGCTGCTGACTCGGAGCCCCACAGCTTGGCACAGGCTCTCTCAGCTCAAGCCTCCGGTCCT
CCCTGGGACCCTGGGAGGCCAGGCCCTGCATCTGAGGTCCTGGCTTTTGTCAAGGCAGGGCCCTGCAGAGACAGG
TGGGCAGGGCCAGCCCCAGGGCCCTGGGCTTCGAACCCGGCTGCTGATCACAGGCCTGTTCGGGGCTGGACTCGG
TGGGGCCTGGCTGGCCCTGAGGGCTGAGAAGGAGAGGCTGCAGCAGCAAAAGCGAACAGAAGCCCTGCGCCAGGC
AGCTGTGGGCCAGGGCGACTTCCACCTGCTGGATCACAGAGGCCGGGCTCGCTGCAAGGCTGACTTCCGGGGCCA
GTGGGTGCTGATGTACTTTGGCTTCACTCACTGCCCTGACATCTGCCCAGACGAGCTGGAGAAGCTGGTGCAGGT
GGTGCGGCAGCTGGAAGCAGAGCCTGGTTTGCCTCCAGTGCAGCCTGTCTTCATCACTGTGGACCCCGAGCGGGA
CGACGTTGAAGCCATGGCCCGCTACGTCCAGGACTTCCACCCAAGACTGTTGGGTCTGACCGGCTCCACCAAACA
GGTTGCCCAGGCTAGTCACAGTTACCGCGTGTACTACAATGCCGGCCCCAAGGATGAGGACCAGGACTACATCGT
GGACCACTCCATTGCCATCTACCTGCTCAACCCTGACGGCCTCTTCACGGATTACTACGGCCGGAGCAGATCGGC
TGAGCAGATCTCAGACAGTGTGCGGCGGCACATGGCGGCTTTCCGCAGTGTCCTGTCTTGAGCCACTGCAGTCTG
GGCCCCATCATTAAACGGGCTGCGTTTAAAA
```

FIGURE 304

MLLLTRSPTAWHRLSQLKPPVLPGTLGGQALHLRSWLLSRQGPAETGGQGQPQGPGLRTRLLITGLFGAGLGGAW
LALRAEKERLQQQKRTEALRQAAVGQGDFHLLDHRGRARCKADFRGQWVLMYFGFTHCPDICPDELEKLVQVVRQ
LEAEPGLPPVQPVFITVDPERDDVEAMARYVQDFHPRLLGLTGSTKQVAQASHSYRVYYNAGPKDEDQDYIVDHS
IAIYLLNPDGLFTDYYGRSRSAEQISDSVRRHMAAFRSVLS

FIGURE 305

```
GTCTGCCCTCTCTGCTCGCCCTGCCTAGCTTGAGGATCTGTCACCCCAGCCATGAGGATTATCGCCCTCCTCGCT
GCTATTCTCTTGGTAGCCCTCCAGGTCCGGGCAGGCCCACTCCAGGCAAGAGGTGATGAGGCTCCAGGCCAGGAG
CAGCGTGGGCCAGAAGACCAGGACATATCTATTTCCTTTGCATGGGATAAAAGCTCTGCTCTTCAGGTTTCAGGC
TCAACAAGGGGCATGGTCTGCTCTTGCAGATTAGTATTCTGCCGGCGAACAGAACTTCGTGTTGGGAACTGCCTC
ATTGGTGGTGTGAGTTTCACATACTGCTGCACGCGTGTCGATTAACGTTCTGCTGTCCAAGAGAATGTCATGCTG
GGAACGCCATCATCGGTGGTGTTAGCTTCACATGCTTCTGCAGCTGAGCTTGCAGAATAGAGAAAAATGAGCTCA
TAATTTGCTTTGAGAGCTACAGGAAATGGTTGTTTCTCCTATACTTTGTCCTTAACATCTTTCTTGATCCTAAAT
ATATATCTCGTAACAAG
```

FIGURE 306

MRIIALLAAILLVALQVRAGPLQARGDEAPGQEQRGPEDQDISISFAWDKSSALQVSGSTRGMVCSCRLVFCRRT
ELRVGNCLIGGVSFTYCCTRVD

FIGURE 307

```
ATAGAATTCGGCACGAGGGGAGAGTTCTACGAGGGAGGGGAAGCGGTTGGACGTGTTCGCTTGGGTTCCTGCTGC
GGCAGCCACCTCGCAATCTCTCTGCATCGATCGCCGCTCGCAAGCTACTGACCGTACTCGGGCGTATTAGGAGCC
GCGTTCCAGCCTCACACCCCACGGTGCTGTTTTCGACTTCAGAAAGGATCTAGCCTCAGCACAGAAGCGCCTCAG
GCGCGGCGCAAAGCTCGAGCGGACGGCGGGGGCGGCCGGAGCCTCTCTCGGGGGAGCCGCGCCTGAGGAGGCGGA
AGAACCCCCCTGACGCGACTGGCGTGTGCTTCTGCCCGCCACCGCCCCTCCCGCTCTCACCCGGGCCGTCCCTGG
CCACTGCCCCTGCCGCGGAGGCAGCGGCGGCAGCGGCTCTCCTTTCCACAGCCGGCGCTCCGCGACCCGCTTGGC
TCCTGAGCCCGTCGGGTAGGCTCTCCTCGAGTTCCCGCTCTTCACCCCTTCCCTCACCCTCTTCTTTCGTCACCC
GTCCCCGACCCCACCCGAGCCCGGCGCCTCAGCTGCCCCCGGCCATGGCGTGCGGAGCCACTCTGAAAAGGACTC
TGGATTTCGACCCGCTGTTGAGCCCGGCGTCCCCGAAGCGCAGGCGATGTGCGCCATTGTCGGCGCCCACCTCGG
CCGCTGCCTCCCCGTTGTCGGCGGCCGCGGCCACCGCCGCCTCCTTCTCCGCTGCGGCCGCCTCGCCGCAGAAGT
ATCTCCGAATGGAGCCATCCCCCTTCGGCGACGTCTCCTCCCGCCTCACCACAGAACAAATTCTGTACAACATAA
AACAAGAGTATAAACGAATGCAGAAGAGAAGACATTTAGAAACGAGTTTCCAACAGACAGATCCGTGTTGTACTT
CTGATGCACAGCCACATGCATTTCTCCTCAGTGGACCAGCTTCACCAGGGACTTCATCTGCAGCATCCTCACCAT
TAAAAAAAGAACAGCCCTTATTTACTCTACGGCAGGTTGGGATGATCTGTGAACGTTTGTTGAAAGAACGTGAAG
AGAAAGTTCGAGAAGAATATGAAGAAATATTGAACACAAAACTTGCAGAACAATATGATGCGTTTGTGAAGTTTA
CGCATGATCAAATAATGCGACGATATGGAGAACAGCCTGCTAGCTATGTTTCATGAATCACGTATCCTGCATTTG
TGGGCTGCCTTGTTCCTTGTTGAGTTGTTGCAAGAGGTCCCAATTATGACATGCAGCAATGCCAATACCCCTTCT
GTGAATACAGGTTATTTCAAGCTTTCGTCAGTGGCAACCACTCTTAGGCAGCAGCAACTGGTTTTGGAAATTTCC
CTGATGTCAGTACCACCTGGATGTGGACCTTTGCTACCTGTATTAATACCAGTGGCCTCATTTTGCTGTATCATT
ACAATTTGGCTTCTTATATTAATGTTTGAAAAGGATTAAAGCTGGTATTCTAGAACATGCCCTTCACTGGTTGTG
TAAATAAAACTGTAGAATGACACTTCAGATGAAGTTAGTGTGATTTTAATTGTGCACTACAACCGAGCTGTAACC
AGTTACTAATTTTAGAATGTAATCCCAGGACAATATTAAGCAAATAGCCTGCAGTGCTTCCTGTGAAATAGTGAA
GGAGGAGGGCATTTCTGTATTCCAGGACTTCTTGGGGTTTCAGAATGGGTTTGTATGATTTTTTTTTTTTTGTA
GTTTTATTTATTCTATCAGTCTTTTTAACAAATGTTTATTGCTGCATTTTTTTTTTTCCAGTGTATCATTGTTT
TACTGCCCTTGTAGTACTGGAATTTAGTTGGAAGAATAAAACATTTACTTCTATTTTGCTTGTTTCTTAATGTAC
AGATGGGGTTAGTATTTGAATAAAGTTGGTGTTTTAAAACGTAAGCATTTTCCAGGAATCAGTGAAGTTAATTTT
CTAAGATTTGAGTGCTGTTTCAAAACACTGAGTTCTGATTCTAAATGCCTTCTTCTGCTGGGCGCGG
```

FIGURE 308

RIRHEGRVLRGRGSGWTCSLGFLLRQPPRNLSASIAARKLLTVLGRIRSRVPASHPTVLFSTSERIXPQHRSASG
AAQSSSGRRGRPEPLSGEPRLRRRKNPPDATGVCFCPPPPLPLSPGPSLATAPAAEAAAAAALLSTAGAPRPAWL
LSPSGRLSSSSRSSPLPSPSSFVTRPRPHPSPAPQLPPAMACGATLKRTLDFDPLLSPASPKRRRCAPLSAPTSA
AASPLSAAAATAASFSAAAASPQKYLRMEPSPFGDVSSRLTTEQILYNIKQEYKRMQKRRHLETSFQQTDPCCTS
DAQPHAFLLSGPASPGTSSAASSPLKKEQPLFTLRQVGMICERLLKEREEKVREEYEEILNTKLAEQYDAFVKFT
HDQIMRRYGEQPASYVS

FIGURE 309

```
CCGGAATGAAAACAAACGGCGGCCGCTGCCGCATCCGGGCACTCTGCTGGTCGCGGCGGGAGTGGCGTGGCGCAG
GGATGGCACAAAAGAAATATCTTCAAGCAAAATTGACCCAGTTTTTAAGGGAAGACAGGATTCAACTTTGGAAAC
CTCCATATACAGATGAAAATAAAAAAGTTGGTTTGGCATTAAAGGACCTTGCTAAGCAGTACTCTGACAGACTAG
AATGCTGTGAAAATGAAGTAGAAAAGGTAATAGAAGAAATACGTTGCAAGGCAATTGAGCGTGGAACAGGAAATG
ACAATTATAGAACAACGGGAATTGCTACAATCGAGGTGTTTTTACCACCAAGACTAAAAAAAGATAGGAAAAACT
TGTTGGAGACCCGATTGCACATCACTGGCAGAGAACTGAGGTCCAAAATAGCTGAAACCTTTGGACTTCAAGAAA
ATTATATCAAAATTGTCATAAATAAGAAGCAACTACAACTAGGGAAAACCCTTGAAGAACAAGGCGTGGCTCACA
ATGTGAAAGCGATGGTGCTTGAACTAAAACAATCTGAAGAGGACGCGAGGAAAAACTTCCAGTTAGAGGAAGAGG
AGCAAAATGAGGCCAAACTCAAAGAAAAACAAATTCAGAGGACCAAGAGAGGACTAGAAATACTGGCAAAGAGAG
CAGCAGAGACAGTGGTGGATCCAGAAATGACACCGTACTTAGACATAGCTAACCAGACAGGCAGATCAATCAGAA
TTCCCCCATCAGAAAGAAAAGCCCTTATGTTAGCTATGGGATATCATGAGAAGGGCAGAGCTTTCCTGAAAAGAA
AAGAATATGGAATAGCCTTGCCATGTCTGTTGGACGCTGACAAATATTTCTGTGAGTGTTGCAGAGAGCTGCTGG
ACACAGTGGATAACTATGCCGTCCTCCAGCTGGATATAGTGTGGTGTTACTTCCGCCTGGAACAGCTGGAATGCC
TTGATGATGCAGAAAAAAAATTAAACTTGGCCCAGAAATGCTTTAAAAATTGTTACGGAGAAAATCATCAGAGAC
TGGTCCACATAAAAGGAAATTGTGGGAAAGAGAAGGTACTGTTTCTAAGACTCTACTTACTTCAAGGGATCCGAA
ACTATCACAGTGGAAATGATGTAGAGGCTTATGAGTATCTTAACAAGGCACGTCAGCTCTTTAAAGAGCTATATA
TTGATCCATCAAAAGTGGACAATTTGTTGCAGTTGGGGTTTACTGCCCAGGAAGCCCGGCTTGGCCTGAGGGCGT
GTGATGGGAACGTGGATCATGCGGCCACTCATATTACCAACCGCAGAGAGGAACTGGCCCAAATAAGGAAGGAGG
AAAAAGAGAAGAAAGACGCCGCCTCGAGAACATCAGGTTTCTGAAAGGGATGGGCTACTCCACGCACGCGGCCC
AGCAGATTCTGCTCAGCAATCCTCAGATGTGGTGGTTAAATGATTCCAATCCTGAAACCGACAACCGTCAAGAAA
GTCCTTCCCAGGAAAACATTGACCGATTGGTGTACATGGGTTTTGATGCACTCGTGGCCGAAGCTGCGCTGAGAG
TGTTCAGAGGCAACGTCCAGCTGGCCGCCCAGACCCTTGCTCACAACGGAGGAAGCCTGCCTCCCGAGCTGCCGC
TGTCGCCAGAAGACTCTTTGTCCCCGCCAGCCACGTCCCCTTCTGACTCCGCAGGAACCTCTAGTGCCTCAACAG
ACGAAGACATGGAGACAGAGGCCGTCAATGAGATACTGGAAGACATTCCAGAGCATGAGGAAGACTATCTTGACT
CAACTCTGGAAGATGAAGAAATTATTATTGCAGAGTACCTATCCTATGTAGAAAATAGGAAGTCAGCAACAAAGA
AAAACTAAATAATGAACAGAAATAGCGCTAATTTTCTGCTTATAAATGCTATCATTATGAAAAGGCTAATGCAGC
TCTTTCTGTTCTTACTTTTTATCTGAATTACAAGTCCTCTTTGGGTGTAGGAGGGGGTGGGCAGGGGACAAGTCC
AGGAGGGGTCCCAGGGCCTTCATGCATGGTCTCGGGGAAGAAGCTTCCTCTGGCCTGGCGCAGGCCGTTCCATCT
GCCTCCCAGGTCTGCGTCCCATAACCCTTTCCCCAGCTTGGTGTTTTACCCCGAAACAGGAAGGAACAGGGGTCC
TGTAGAACAGGGGTCCTGGGGAAGGTGTCCAGGGCAGGGTCCTGGGAAGGGTGTCCCGACTGCTTCCTCTCCAGC
TGTGGCTCCATCTGCCCAGCTTGCCTGCCTCCTGCACCCACTGCCCTGACCTTCCTGCTTCCCACGCTGCCATCT
CTGCCAGGGTGCCACATGGGTTCCTGTGCCACCCTTTCCCCGCCCCTCAAATCGTCCTTTAAGTCTTCCTTCCAA
GTGCTGTGGGGCATAACGATGAGGCGCTGGCCTTGGGGGCCACACCAGGTCGCAGCAAATGGCTTCAGCCTGGGA
CGCCAGTGTTTATGCTCTTAGTTCAGTAAAATACGCCCCGAAATTCAAGATTGAGTGTCAGGCTTTATATATA
TTCAGCATTCCTCATTACAGAAATCTTCTATTGAATGGGAAAGGTTTAAATGCTAACCAAAGCAATTTATTTTA
ATTAATATTTTTAGACTCTGTGCTGTCATACTGAACTCACTGCTAGCTAAGAGACCTATCAGAGATTTAGATATA
TTTTCTCCAGGTTTTTTGTGGGTTTTCTTTGTTGTTGTTGTTCTAGCCATGTGACAGAGGCTCTTTCTAAAA
GTATGTAGTTCGCTGTGTGTCGGCTCCAGCAGTAACCGTCCTCACTGCGCCACGCACTCCTCTGTAGATGTGTGC
CCAGTGGGAGTTCCTTCCAGCCCCAGGACCGCAGCAGCAGCCAGGTGCCGAGTGGATTGAGTGCCAGGTGCATCC
AAGACTTTCCCTCCCTTCCAGAAGGCACTGACTGAAGACAGGATGGATCATGCGGAGCCGGCTGAAATGCTCCAA
CTTTTTCAAAGTGTGGGTGGTCCAGTTTGGACTGATGGGAATCTTCTTGTCATTCTTTTTAAACGGATGATACCG
ATGGAAATAAAAGGTGGGAAATATATTCAAAAAAAAAA
```

FIGURE 310

MAQKKYLQAKLTQFLREDRIQLWKPPYTDENKKVGLALKDLAKQYSDRLECCENEVEKVIEEIRCKAIERGTGND
NYRTTGIATIEVFLPPRLKKDRKNLLETRLHITGRELRSKIAETFGLQENYIKIVINKKQLQLGKTLEEQGVAHN
VKAMVLELKQSEEDARKNFQLEEEEQNEAKLKEKQIQRTKRGLEILAKRAAETVVDPEMTPYLDIANQTGRSIRI
PPSERKALMLAMGYHEKGRAFLKRKEYGIALPCLLDADKYFCECCRELLDTVDNYAVLQLDIVWCYFRLEQLECL
DDAEKKLNLAQKCFKNCYGENHQRLVHIKGNCGKEKVLFLRLYLLQGIRNYHSGNDVEAYEYLNKARQLFKELYI
DPSKVDNLLQLGFTAQEARLGLRACDGNVDHAATHITNRREELAQIRKEEKEKKRRRLENIRFLKGMGYSTHAAQ
QILLSNPQMWWLNDSNPETDNRQESPSQENIDRLVYMGFDALVAEAALRVFRGNVQLAAQTLAHNGGSLPPELPL
SPEDSLSPPATSPSDSAGTSSASTDEDMETEAVNEILEDIPEHEEDYLDSTLEDEEIIIAEYLSYVENRKSATKK
N

FIGURE 311

```
TTTCTGGTCTAGATCCATCTGTACCAACAAGTTCATCACTTTACAGAACGAATCTTTTTATCCGTACAGGAGGTT
CAAACCATGTCTGCCTCTTCCTTTGTAATGAATGACCTTTCTATGAGCTGTGACAAAATTTCCGAACAATTAGCT
AAGGATTTGGGAAGAGGGGGTGGCAAACGGGGCTTTCTGTTTTCCTGCCTCAGCATGAAAACATCTGATTTATGC
TTTATGGAAGCCTTACCTCCAATCCCCAACTGTTAAGTCCCATGAAACCACAGTTGCTCTGGGCTGATGGAAACA
AAAGGAAACAGTATGAAGAGTTCCTTAATCATTTTTGAAACAAAAATGTTAAGGGATTTTAAACATATGATTATT
TTTAATTTTATGCCTTTTCAGTACTAAACACCCATTTCATTGCTGATTCCTGTCTAAGAAGCCATTCACGTCAGC
ATGGCGATAGAAAGAATGAAAAAACCCTGCTGAATCATACAGTAATTTTCTTTAAAGCACATAGTAGTTACATAA
ANANATATATATAAATATANTTTNGTTTATAACTAACACAAGGCAGGATCTTGTGACTCTAAGAGTGCGTTTTGT
CATCAAGACAAAACAGATGCAAGATGCATCACTGCATTACTTCCATAGAGTTGTAAAATAATCCTTAATATTAGA
ATATTTTCTGTCACTTAGCAAAAGTGGTTCAGTTCATTGCCGCGCCCATCATGTTCTTGACTATTTGATCCACT
TTTTCGTTTATGTCAACCCCTTCCCTCTCTGGCTAAATAAAGTGGATGCAGAAAGCTCCTTAAATGGAGATATCG
ATTGCCTTGGAATCACAATCCTGATTTGAAAATTCCTCATGAATGAAGAAAGGAATGGCATCCCTTGAGAAGGA
AAGTGGTTAATATACATACTGAGCTCCTAAAGTTTAAATTCAGGTACTGAGTGTACAATTTCACCAACATTCTAA
CCCATGAAACTTTTACACTCTGTGCCAAGAAACTGTTGGCTTTTGTAAGGTACAGTGCTCAACATTTGCAGATTC
AGGTCTCAAGAAGCAGAGATGTCTCATAAGCAGCATTTTCCCAACAGTTTAGCATCTGTACACATCTGCCTTGGT
CATCAGTCCACTCACAGAGTACCATACTTTATCATCACAAGTGTCTGACGTGAACGAATGCCATTTTCTATTCCA
TATATTTTGCTTTACAATTTTAAGTATTTGATGAAGATGGTAACTTTTTCCTAACTTAGTTAACTATTAAAAAAA
ATTTTGAAAAGCAAGGTGATTGAAGGATTGTGATGACAATCTCTTTGCAGCAGCTATGTATGGTTTATGTGAAGT
ATCCCCACTTATTCTTGTGGAGCAGGTTTGGTGAGACAGCAGTAACCAAATGACATGCCAATATTACTGGTGCAA
CTGGTATTCTACAAATGCATAAGGAACACATAGACGACTTCCTTTTAGGATAAAATGATGCTTCTTCACTACCT
TTTGTGGTAGCTGTGGCTTCCAATAGCAACTGTTTGACAGTTATATAAATCTTGCATGTGTATTCTTAGTTTGTG
TCCCTTAAGTACTACTTAATTCTCAAGTAGTAATGTTATTCTTATACCCTTCAGCGTTCTATTTTGATTCAAAAC
AATTGATTCAAAACAATTTTGAATCAATTTTCTATTTTGATTCAAAACAATTGATAATTCTATAAAAAAACATAA
ACACTGAATTCTTCAGTGAACCAAAGCAACAAATAATAGAGAAAACTTCTTGAAACTGGAGTGTGGGAAAACTTC
TTAACAGAACTAAGAGTTAAAGGTAGTGAGAAGTGTGTGGTGTGTGAATTCTTTAGTGGTAAGGGGAAATGTGGG
CTAAATCCTTTTCTTTCATGAAACTCTCATTCTATTTTATATTTCTGGTTTGTTCTTGTTCCCATGTGAGAAAAC
ATACAGTTTCTGAAAATTCAAAATGGTCATCAATGCTTTGGACTTTACATAATTATGTATTAGAGAAGGTGCAAC
TGTACATTACTTAATATACTATGAACATAATAGAATAACAAAAAAAGATAACAAAGAGATGCAAACTTCTGGATA
AATCAGATAAATGGTGCTACAGAGGAATTTAGTTATTTCAGCTTAATTATTTGTAAAAATAATAATCAGTGACTA
GGTAAAGATACTGAATCTCAAGAAAAATATCTTGACCCATTTATGTCTAGTG
```

FIGURE 312

FWSRSICTNKFITLQNESFYPYRRFKPCLPLPL

FIGURE 313

GGCACGAGGCCTGACATGGAGCCTGCCAGCTCCGTCAGCCCTGACTCGGCCCGGAGCTGAGCTCCCCACCTGCCG
GTAGCCCAGGAGATGGAGCAGCCCAGCCCACGTGCCCGGCCTTCCGCCCCTGACTTCACTTGATAACAAACTAGA
AACTGAAACAGGGTCGGGATGCCGATGCCGGCTTGGAGTTAGAGATGAGTCACCGCTGAGAGCAGCTGCAGTAGC
TGAGCAGTGGCAGCAGAGAGGCAGACGTGAGCTGAGGGCGCAGAGGCAGGCAGCATCTCTGAGGGTCCCCAAGGA
GCATGGCTGGGAGCCGTGAGGTGGTGGCCATGGACTGCGAGATGGTGGGGCTGGGGCCCCACCGGGAGAGTGGCC
TGGCTCGTTGCAGCCTCGTGAACGTCCACGGTGCTGTGCTGTACGACAAGTTCATCCGGCCTGAGGGAGAGATCA
CCGATTACAGAACCCGGGTCAGCGGGGTCACCCCTCAGCACATGGTGGGGGCCACACCATTTGCCGTGGCCAGGC
TAGAGATCCTGCAGCTCCTGAAAGGCAAGCTGGTGGTGGGTCATGACCTGAAGCACGACTTCCAGGCACTGAAAG
AGGACATGAGCGGCTACACAATCTACGACACGTCCACTGACAGGCTGTTGTGGCGTGAGGCCAAGCTGGACCACT
GCAGGCGTGTCTCCCTGCGGGTGCTGAGTGAGCGCCTCCTGCACAAGAGCATCCAGAACAGCCTGCTTGGACACA
GCTCGGTGGAAGATGCGAGGGCAACGATGGAGCTCTATCAAATCTCCCAGAGAATCCGAGCCCGCCGAGGGCTGC
CCCGCCTGGCTGTGTCAGACTGAAGCCCCATCCAGCCCGTTCCGCAGGGACTAGAGGCTTTCGGCTTTTGGGAC
AGCAACTACCTTGCTTTTGGAAAATACATTTTTAATAGTAAAGTGGCTCTATATTTTCTCTACGCAAAAAAAAAA
AAAAAAAA

FIGURE 314

MAGSREVVAMDCEMVGLGPHRESGLARCSLVNVHGAVLYDKFIRPEGEITDYRTRVSGVTPQHMVGATPFAVARL
EILQLLKGKLVVGHDLKHDFQALKEDMSGYTIYDTSTDRLLWREAKLDHCRRVSLRVLSERLLHKSIQNSLLGHS
SVEDARATMELYQISQRIRARRGLPRLAVSD

FIGURE 315

```
ATTGATAATACTTTTAATGTGTTGGTAATGATGTTTAAAATTGAAAGATTTTTAAAATAAAAATGATAGATTTTC
TTACTAAAAATGTTTTTATTAACCTTGCTTTTATTGGAAAAAATCAAGCAATATTTCTTTTTCTTTTGTGTTATA
TTGTACTTTACTGATTCATTTACTGGTGATACATATGTTTTATGGATTTTCCAGTTTAATTTGCATATACAAAT
GAATGCAATGGTCTATTGGTGAGCATTGAGCAACACTGTATAAAGTTTTAAAAATGTAAACACTTTTTAATCTAC
TTTCCTCTAAAAATCAATAATATTCTATTATTTCTAATCCTTTTCCACTTGGGAAATAACAATGAAGAATCTGAG
AATTTGACATCTATAACTTTACAGATTCATTTTTCCATTTAAATTTCAGTTTCTTGGATCACTGAATATGGGAAG
GGAGAGCTTCACTAATTAGACGCAGCTTCTTAAGAACTTATATTCTCTTTGACATACATCTCTATTGTAGTTTTT
TGTTTTGTTTGTTTTTTGAGATGGAGTCTTGCTCTGTCACCCAGGCTGGAGTGCAGTGGTGCAATCTCAGCTCA
CTGCAACCTCTGCCTCCTGGGTTCAAGTGATTCTCGTACCTCAGACTCCCGAGTAGTTGGGATTACAGGTGCCCA
CCACCACACCCGACTAATTTTTGTATTTTTAGTAGCCATGGTTTTGCCATGTTGGCCAGGCTGGTTTCGAACT
CCTGACCTCAGGTGATCCACCCACCTCAGCCTCCCAAAGTGCTGGGATTACAGGTGTGAGCCACCGTTCCCGGCC
TATTGTAGATTTCTTAACTACTTGCTAAGGAAATCATATCCTTTTACATGAACTACAGGTTTAGAACTTGGTTT
TAAGACAACTGCTATGGCCAGAAGGTAAATGGGAATTGCCTTATTGAAGGTAACATTGATTGCCTAATAAGAAAA
TGAATTGTTTGCCACAGAGTTGAATTTAATTTGAGTTAGATAGTTCAGAATGTAGCACTTGCCCTATAAATGAAT
CAGATTTGTTCTATTTATATAATATTAGAATTAATATATTATCATGTAAGTGGGAATTTTATTTTGTTAAGTGGA
CTCTCAAATTTTAGAACTTGTGTGAAATATCTCCCAGAAAACACAAAAGGTTTCAAGGTATCACCCAAAGCTAGG
GAATCAACGAACGTACTTTATTAATGCAAGACCACAATTTAAGCCCCAGGCAGGAATCCAACAGTAACATTTTTC
CTTAGGTTAAGCAGTAATTTTTTGAATTGTCATTTTTAATGGGTCTCACACATGCATATTGCTAATATCATTC
ATGTTTGAGGTTTTCAACAAAGAACCAATTTGTTAATATAATGTACAAAAATAGTTGGTTCATTTCTGAATTCA
GTCTTTGAAATAAAACTCCTTGTTTTGGCCGTGTTTCTGAATGTATTGGTGATTCACCCCCAAGCTAATTTTTTA
AAGTCATTTTTGAAGTTGGGAAGTCTCATGAGAGATGTTGAAGTATGTATTTAATCAAGAGTCATGATTTCAAAC
TAGTTTTACATATTAAGCAGTTGGTGTTCTAATTTAATGGGTAAATGTGTGTTTGGATAAATATCTGAAAATTTT
ATCCTTAAGTATATATAATTATTTGCCTCTTATATGTCTTAAAGCTATTTAAACAAGGTGTTAAATGAGCCAAAA
CAATTAAGTAATTAGAACAGTACATTTTTATCAGAGTGTCTGTCATATGCAATGAATGTATGTAATACTAAAAAA
TCATGACTACTTTTATCAAAGAAAAACCACACATTAATCCTATTAATCATGAAAGCGTAGCATTGTAAATTAAAG
GTTTTCTTTGAGGCTCTTGAAAGTGATCCCATTGCTTTCCTGTTTTAAAAATATTTTATGCTCTTTATTTCCACT
TCTGTGAATGTGATATTTCTATTTTGTGATTATGTTACTGAATAAACAAACTTGCTACATAAAATTCTTAGCAAT
T
```

FIGURE 316

```
CCCAAACCCACTCCACCTTACTACCAGACAACCTTAGCCAAACCATTTACCCAAATAAAGTATAGGCGATAGAAA
TTGAAACCTGGCGCAATAGATATAGTACCGCAAGGGAAAGATGAAAAATTATAACCAAGCATAATATAGCAAGGA
CTAACCCCTATACCTTCTGCATAATGAATTAACTAGAAATAACTTTGCAAGGAGAGCCAAAGCTAAGACCCCCGA
AACCAGACGAGCTACCTAAGAACAGCTAAAAGAGCACACCCGTCTATGTAGCAAAATAGTGGGAAGATTTATAGG
TAGAGGCGACAAACCTACCGAGCCTGGTGATAGCTGGTTGTCCAAGATAGAATCTTAGTTCAACTTTAAATTTGC
CCACAGAACCCTCTAAATCCCCTTGTAAATTTAACTGTTAGTCCAAAGAGGAACAGCTCTTTGGACACTAGGAAA
AAACCTTGTAGAGAGAGTAAAAAATTTAACACCCATAGTAGGCCTAAAAGCAGCCACCAATTAAGAAAGCGTTCA
AGCTCAACACCCACTACCTAAAAAATCCCAAACATATAACTGAACTCCTCACACCCAATTGGACCAATCTATCAC
CCTATAGAAGAACTAATGTTAGTATAAGTAACATGAAAACATTCTCCTCCGCATAAGCCTGCGTCAGATTAAAAC
ACTGAACTGACAATTAACAGCCCAATATCTACAATTAACCAACAAGTCATTATTACCCTCACTGTCAACCCAACA
CAGGCATGCTCATAAGGAAAGGTTAAAAAAAGTAAAAGGAACTCGGCAAATCTTACCCCGCCTGTTTACCAAAAA
CATCACCTCTAGCATCACCAGTATTAGAGGCACCGCCTGCCCAGTGACACATGTTTAACGGCCGCGGTACCCTAA
CCGTGCAAAGGTAGCATAATCACTTGTTCCTTAATTAGGGACCTGTATGAATGGCTCCACGAGGGTTCAGCTGTC
TCTTACTTTTAACCAGTGAAATTGACCTGCCCGTGAAGAGGCGGGCATAACACAGCAAGACGAGAAGACCCTATG
GAGCTTTAATTTATTAATGCAAACAGTACCTAACAAACCCACAGGTCCTAAACTACCAAACCTGCATTAAAAATT
TCGGTTGGGGCGACCTCGGAGCAGAACCCAACCTCCGAGCAGTACATGCTAAGACTTCACCAGTCAAAGCGAACT
ACTATACTCAATTGATCCAATAACTTGACCAACGGAACAAGTTACCCTAGGGATAACAGCGCAATCCTATTCTAG
AGTCCATATCAACAATAGGGTTTACGACCTCGATGTTGGATCAGGACATCCCAATGGTGCAGCCGCTATTAAAGG
TTCGTTTGTTCAACGATTAAAGTCCTACGTGATCTGAGTTCAGACCGGAGTAATCCAGGTCGGTTTCTATCTACT
TCAAATTCCTCCCTGTACGAAAGGACAAGAGAAATAAGGCCTACTTCACAAAGCGCCTTCCCCCGTAAATGATAT
CATCTCAACTTAGTATTATACCCACACCCACCCAAGAACAGGGTTTGTTAAGAAAAAAAAAAAAAAA
```

FIGURE 317

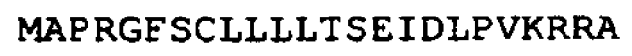

MAPRGFSCLLLLTSEIDLPVKRRA

FIGURE 318

```
GCCATCTGGGCCCAGGCCCCATGCCCCGAGGAGGGGTGGTCTGAAGCCCACCAGAGCCCCCTGCCAGACTGTCTG
CCTCCCTTCTGACTGTGGCCGCTTGGCATGGCCAGCAACAGCAGCTCCTGCCCGACACCTGGGGCGGGCACCTC
AATGGGTACCCGGTGCCTCCCTACGCCTTCTTCTTCCCCCCTATGCTGGGTGGACTCTCCCCGCCAGGCGCTCTG
ACCACTCTCCAGCACCAGCTTCCAGTTAGTGGATATAGCACACCATCCCCAGCCACCATTGAGACCCAGAGCAGC
AGTTCTGAAGAGATAGTGCCCAGCCCTCCCTCGCCACCCCCTCTACCCCGCATCTACAAGCCTTGCTTTGTCTGT
CAGGACAAGTCCTCAGGCTACCACTATGGGGTCAGCGCCTGTGAGGGCTGCAAGGGCTTCTTCCGCCGCAGCATC
CAGAAGAACATGGTGTACACGTGTCACCGGGACAAGAACTGCATCATCAACAAGGTGACCCGGAACCGCTGCCAG
TACTGCCGACTGCAGAAGTGCTTTGAAGTGGGCATGTCCAAGGAGTCTGTGAGAAACGACCGAAACAAGAAGAAG
AAGGAGGTGCCCAAGCCCGAGTGCTCTGAGAGCTACACGCTGACGCCGGAGGTGGGGGAGCTCATTGAAGGTG
CGCAAAGCGCACCAGGAAACCTTCCCTGCCCTCTGCCAGCTGGGCAAATACACTACGAACAACAGCTCAGAACAA
CGTGTCTCTCTGGACATTGACCTCTGGGACAAGTTCAGTGAACTCTCCACCAAGTGCATCATTAAGACTGTGGAG
TTCGCCAAGCAGCTGCCCGGCTTCACCACCCTCACCATCGCCGACCAGATCACCCTCCTCAAGGCTGCCTGCCTG
GACATCCTGATCCTGCGGATCTGCACGCGGTACACGCCCGAGCAGGACACCATGACCTTCTCGGACGGGCTGACC
CTGAACCGGACCCAGATGCACAACGCTGGCTTCGGCCCCCTCACCGACCTGGTCTTTGCCTTCGCCAACCAGCTG
CTGCCCCTGGAGATGGATGATGCGGAGACGGGGCTGCTCAGCGCCATCTGCCTCATCTGCGGAGACCGCCAGGAC
CTGGAGCAGCCGGACCGGGTGGACATGCTGCAGGAGCCGCTGCTGGAGGCGCTAAAGGTCTACGTGCGGAAGCGG
AGGCCCAGCCGCCCCCACATGTTCCCCAAGATGCTAATGAAGATTACTGACCTGCGAAGCATCAGCGCCAAGGGG
GCTGAGCGGGTGATCACGCTGAAGATGGAGATCCCGGGCTCCATGCCGCCTCTCATCCAGGAAATGTTGGAGAAC
TCAGAGGGCCTGGACACTCTGAGCGGACAGCCGGGGGGTGGGGGCGGGACGGGGTGGCCTGGCCCCCCGCCA
GGCAGCTGTAGCCCCAGCCTCAGCCCCAGCTCCAACAGAAGCAGCCCGGCCACCCACTCCCCGTGACCGCCCACG
CCACATGGACACAGCCCTCGCCCTCCGCCCCGGCTTTTCTCTGCCTTTCTACCGACCATGTGACCCCGCACCAGC
CCTGCCCCCACCTGCCCTCCCGGGCAGTACTGGGGACCTTCCCTGGGGGACGGGGAGGGAGGAGGCAGCGACTCC
TTGGACAGAGGCCTGGGCCCTCAGTGGACTGCCTGCTCCCACAGCCTGGGCTGACGTCAGAGGCCGAGGCCAGGA
ACTGAGTGAGGCCCCTGGTCCTGGGTCTCAGGATGGGTCCTGGGGGCCTCGTGTTCATCAAGACACCCCTCTGCC
CAGCTCACCACATCTTCATCACCAGCAAACGCCAGGACTTGGCTCCCCCATCCTCAGAACTCACAAGCCATTGCT
CCCCAGCTGGGGAACCTCAACCTCCCCCCTGCCTCGGTTGGTGACAGAGGGGGTGGGACAGGGGCGGGGGGTTCC
CCCTGTACATACCCTGCCATACCAACCCCAGGTATTAATTCTCGCTGGTTTTGTTTTTATTTTAATTTTTTTGTT
TTGATTTTTTAATAAGAATTTTCATTTTAAGCACATTTATACTGAAGGAATTTGTGCTGTGTATTGGGGGGAGC
TGGATCCAGAGCTGGAGGGGTGGGTCCGGGGGAGGGAGTGGCTCGGAAGGGGCCCCCACTCTCCTTTCATGTCC
CTGTGCCCCCAGTTCTCCTCCTCAGCCTTTTCCTCCTCAGTTTTCTCTTTAAAACTGTGAAGTACTAACTTTCC
AAGGCCTGCCTTCCCCTCCCTCCCACTGGAGAAGCCGCCAGCCCCTTTCTCCCTCTGCCTGACCACTGGGTGTGG
ACGGTGTGGGCAGCCCTGAAAGGACAGGCTCCTGGCCTTGGCACTTGCCTGCACCCACCATGAGGCATGGAGCA
GGGCAGAGCAAGGGCCCCGGGACAGAGTTTTCCCAGACCTGGCTCCTCGGCAGAGCTGCCTCCCGTCAGGGCCCA
CATCATCTAGGCTCCCCAGCCCCCACTGTGAAGGGGCTGGCCAGGGGCCCGAGCTGCCCCCACCCCCGGCCTCAG
CCACCAGCACCCCATAGGGCCCCAGACACCACACACATGCGCGTGCGCACACACACAAACACACACACACTGG
ACAGTAGATGGGCCGACACACACTIGGCCCGAGTTCCTCCATTTCCCTGGCCTGCCCCCCACCCCCAACCTGTCC
CACCCCCGTGCCCCCTCCTTACCCCGCAGGACGGGCCTACAGGGGGGTCTCCCCTCACCCCTGCACCCCCAGCTG
GGGGAGCTGGCTCTGCCCCGACCTCCTTCACCAGGGGTTGGGGCCCCTTCCCCTGGAGCCCGTGGGTGCACCTGT
TACTGTTGGGCTTTCCACTGAGATCTACTGGATAAAGAATAAAGTTCTATTTATTCT
```

FIGURE 319

MASNSSSCPTPGGGHLNGYPVPPYAFFFPPMLGGLSPPGALTTLQHQLPVSGYSTPSPATIETQSSSSEEIVPSP
PSPPPLPRIYKPCFVCQDKSSGYHYGVSACEGCKGFFRRSIQKNMVYTCHRDKNCIINKVTRNRCQYCRLQKCFE
VGMSKESVRNDRNKKKKEVPKPECSESYTLTPEVGELIEKVRKAHQETFPALCQLGKYTTNNSSEQRVSLDIDLW
DKFSELSTKCIIKTVEFAKQLPGFTTLTIADQITLLKAACLDILILRICTRYTPEQDTMTFSDGLTLNRTQMHNA
GFGPLTDLVFAFANQLLPLEMDDAETGLLSAICLICGDRQDLEQPDRVDMLQEPLLEALKVYVRKRRPSRPHMFP
KMLMKITDLRSISAKGAERVITLKMEIPGSMPPLIQEMLENSEGLDTLSGQPGGGGRDGGGLAPPPGSCSPSLSP
SSNRSSPATHSP

FIGURE 320

```
ATTCGGAACAGAGCAATCTGAGACAGGTGCGGCAAGTCTACTGCGGGCTGGTCCGGGCTCCTCAGGTTCAGACCC
GACCGTTATCCAGTCGGTTCGTGGAGAGGAGAGGTGCACTTTACAGGTCCCCGATGAACCAAGAGAACCCTCCAC
CATATCCAGGCCCTGGTCCAACGGCCCCATACCCACCTTATCCACCACAACCAATGGGTCCAGGACCTATGGGGG
GACCCTACCCACCTCCTCAAGGGTACCCCTACCAAGGATACCCACAGTACGGCTGGCAGGGTGGACCTCAGGAGC
CTCCTAAAACCACAGTGTATGTGGTAGAAGACCAAAGAAGAGATGAGCTAGGACCATCCACCTGCCTYACAGCCT
GCTGGACGGCTCTCTGTTGCTGCTGTCTCTGGGACATGCTCACCTGACCAGACCAGCCCAGCCGTCCTGTCCTGC
CAGCTCTGCTGCCACCTCTGACAGGTGTGCCTGCCCCCATCTCTTCTGATTGCTGTTAACAAATGACTAGCTTTG
CACAGACACCTCTACCTTCAGCACTATGGGATTCTAGATTAATGGGGGTTGCTACTGTTTAATTCAGTGACTTGA
TCTTTTTAATGTCCAAAATCCATTTCTTATTGATCTTTAAAGATGTGCTAAATGACTTTTTTGGCCAAAGGCTTA
GTTGTGAAAAATATAATTTTTAAATTATACATTCAAGGTAGTGGCCAAATGTAACACATCAATCATGGAATGATT
TCTCTGCTAACAGCCGCCTGTATGTTTCAATAAATTTGTCCAAAGCTC
```

FIGURE 321

MNQENPPPYPGPGPTAPYPPYPPQPMGPGPMGGPYPPPQGYPYQGYPQYGWQGGPQEPPKTTVYVVEDQRRDELG
PSTCLTACWTALCCCCLWDMLT

FIGURE 322A

```
GATCAATACTGAGGCCGCGTCGACCCCCTTGAGCCGAGACCCCCCCCAGCCCAGCCCCCACCCCACCCCCCGCA
CACGCCCCACCCCCCCCACGACCCAGCCTCATACCGCACCAGCTGAGGCACCCAAGAGGATTACCCCCTGGGGCC
CTCTCCCGCCCCCCAAAAAAGAGAAGATCCCCTCTCCTGGCCCATCCCTTCCCTTCTTCCCTCCCCCCTCCCCCC
GAACTTTCCCTCTCGCATGCTTTTCCCCTGCACCACGGATCGCCTCTCGGATGCCGCTTGCCTGGAAGCTGCGTT
AGGAGCGAGCGGCGGCGGTGGCGGCGGTGGCGGCGGCGGCGGCAGCTCGGGAGTGCTATGACCGGCAAACTCGCC
GAGAAGCTGCCGGTGACCATGAGCAGTTTGCTAAACCAACTGCCTGACAATCTGTACCCCGAGGAGATCCCCAGC
GCGCTCAACCTCTTCTCCGGCAGCAGCGACTCGGTAGTCCATTACAATCAGATGGCTACAGAGAATGTAATGGAC
ATCGGTCTGACCAACGAGAAGCCCAACCCGGAACTCTCTTACTCCGGCTCCTTCCAGCCAGCCCCGGGAACAAG
ACCGTGACCTACTTGGGAAAGTTCGCCTTCGACTCCCCTTCCAACTGGTGCCAGGACAACATCATTAGCCTCATG
AGCGCCGGCATCTTGGGGGTGCCCCCGGCTTCAGGGGCGCTAAGCACGCAGACGTCCACGGCCAGCATGGTGCAG
CCACCGCAGGGTGACGTGGAGGCCATGTATCCCGCGCTACCCCCCTACTCCAACTGCGGCGACCTCTACTCAGAG
CCCGTGTCTTTCCACGACCCCAGGGCAATCCCGGGCTCGCCTATTCCCCCCAGGATTACCAATCGGCCAAGCCG
GCGTTGGACAGCAATCTCTTCCCCATGATTCCTGACTACAACCTCTACCACCACCCCAACGACATGGGCTCCATT
CCGGAGCACAAGCCCTTCCAGGGCATGGACCCCATCCGGGTCAACCCGCCCCCTACTACCCCTCTGGAGACCATC
AAGGCATTCAAAGACAAGCAGATCCACCCGGGCTTTGGCAGCCTGCCCCAGCCGCCGCTCACCCTCAAGCCCATC
CGGCCCCGCAAGTACCCCAACCGGCCTAGCAAGACACCGCTCCACGAACGGCCCCACGCGTGCCCGGCCGAGGGC
TGCGACCGCCGTTTCAGCCGTTCGGACGAGCTGACCCGGCACCTGCGCATCCACACGGGCCACAAGCCCTTCCAG
TGCCGGATCTGCATGCGGAGCTTCAGCCGCAGCGACCACCTCACCACTCACATCCGCACTCATACGGGCGAGAAG
CCCTTTGCCTGCGAGTTCTGCGGGCGCAAGTTTGCGCGCAGCGACGAGCGCAAGCGCCACGCCAAGATCCACCTC
AAGCAAAAGGAGAAGAAGGCGGAGAAGGGCGGTGCACCCTCTGCATCCTCGGCGCCCCCGTGTCGCTGGCCCCC
GTGGTCACCACCTGCGCCTGAGGATCGGGCCCCAGATCCCCACTTTTCCCCTCCAGTGCCTCCCGGCTGCTAGC
CTGAAAGCAGCGGGAAAGCCAGCCACGGAGGCGTAGGGCCGCGCCCTGGCCTCTCCATGGACGTGCGGCCCCTT
GCTTCCCCTTCGATGCCCCCGGTTCCCAACCTTTCACGCCGGCCAGCGGTCAGGGGCCAGGGCTGGAGGCGCCTT
CCCCTCGCGGTCCCCCACTTAGCCAAGGCGTGGGGGCGGAAAGGTGGCGTCTAGCCCGCTTTGTTCAGTTCGGAT
CGCCTTGATCCAGGGGCCGCCGGGCCGCGCCAAGGACCTGCAAGGGACTGAAGGCGGAGCCCATCCAACCCTCGC
CCGACCCAAACACCTCATTGTTTCCCCCACGTCTCCCTCTATACCCCCTCGAAGACTCGAGAGGGGGAGGGGGTA
AGGAGCGCACCAAAGCGCAGAGCTTGCTGCCCGCCGCACGCACGCGCGCCTGCGTGCGGGGATGCGCGCGAGTGT
GTGCGTGCTCGCGTGTGTGTATGTGTGTGTGTGAGTGTGTGTGTGTGCGCGCGCGCAAGCGTGTGTGTTTAAG
ACTCTTGAGCTGAACTGGGCTGTGTTTACCCCAAACTCTTCCCCACCTCGGGTCCCCAAGCCGCTGGGAGATGTC
CCATGCTGGGGGTCCGCACGTGGCTGGAGGAGGTGGTCTTCCATCCGCTCTGAAATCATGTTTCTTAGAGAAATG
CCTCGGATGCCGCCGACGCGGTGCTGCTGCCGCCGCTTCGGGTTTGGCCCCTCAGAACCCCTCCTTTTCTGAGCG
CTTCCCTCTTAGGCCTCAGGGCAGTTTGATCTGTGGGGAGAAAGAGCAGCCATCGCTGAGCCTGCCTTTTAAAAT
ATATGTGTATTTCCTTAGCCCCACTCTAAGAAATCTATGTTCCTGAGTTTGCCCCCTGCCCTCCCACTCCTTCCC
CTTTTCCCCTCTAAACCTTCTCCCATCTCTTTCAAAATCTTTTCCCAGAAAGGCAGGCTTCAACCAGCCACTCCA
GCTTTGTGTCTTCTCTCAATTACATAGCAATTTCTCCTTCCCACCATCATGGGGAAGCTGGCTCTGCTTTTGCCC
TTTGTCATCACCAACACAACAGATAGAATTTAAATATAAGTATATGGTGTGCGTGTGTATGTATGTGTATGTATA
TGCATGCATGTGTATAAAGATGCACATGCGTACATATACATAACATACACACAATATGTATTCCTAGCAAAATAA
AATCTCTAAGGTACTTGGTTATCCAGTGCAGTGCACCGGAATAAAGAGAATTTGTAGGCGTATACAGCTTTAAAT
GATTTATTTTTTATGAAAATGTTAACTGATGAGATTATATCTACATACGTGTGTTATGTGTGTGGATATAGATGC
ACACATATCTGTACATATACATGTGAGTGTACATATATACACATATACACATCTATGTATGGATATGTGTATA
CACATATACACATCTCTGTCCAAAATTTCCTCAAAGATATGGGGATTTTTTCATGAATCCATGTGGATGAATGAG
GTGTCTCCTTTCCATACCCAGTCTCACCTTCTCCCCACCCTACCTCACCTCTTCTCAGGCACCCCTCTTCCCCAG
CTGTCCTGCCAGCCCTTCTCGTACAGGGTGGCTCCTTTGAAGTGGAGTAATAGGGAAGGTTGCTCTCTGCCACAG
CTTGCAGCATGGTCTTGACTGAATGTACTGTTCCTGTTAGCGTTACTTCTCCTGTGGTCAGTAAGTTGCCCAGAG
AGAAGGAACAAAGGTCTGGAGTTTACAGAATGTCTGTTTTTAAAGTCACTTTATGCGTTTTCCACTTTTTTCTTT
TTTAAGAAAAAGAAGTACCATTTTTGTTTTGTTTTGTTTTGATTTTTGGTGGTGGATAAATAATACTAAAAGGAC
TCTAGTGGAAAGGGGGGATATCGAAGAGCAGGGGTTGTGAATTTCCAGGTACTTGGACTTTTTGTAGAAGTAGA
GAGAAGAAGATGAAGTTTGCCAGGAGGGCCCATATTTTTTCAGCTGAAGGGTAAAATCTTTCTTTGCAGAGACAG
```

FIGURE 322B

```
TATTTTGCTGAATACTTTTTATAATGTGATGATTATTAAAAAAAGCAAAAATTTTGGTCACTTCCAAGCTAGAAGG
AGGAATCAGATACCCTTTAATATTTTTTCCTCGCTCCTTCTGGTATATGCATGTCACTGCATGATAATTGAGTTT
TCCTTTGTTTTAATAAAACTGTTCTCAGACATTAAGCTAAACTAAGAGAAAAATAACTTTGTTGCCAAAAGGTTG
TGCTATCCAGATTTTTTATATGTCTGCATGTTTAAAAAAAAAAAAAGCAACAAAAGAAAATGCACTCTAACTTATG
TGAACTGAGAGAAAAAAATCAGGTTTTAAACAGGAAAACCTATGGGGAATGATATTTTTTGAAAGACTTTTGTAT
AAAGTTGAGTACTTAGAAAAAAGACAAACCAGATGTAATATATTTTGTGGATGTTTTTATTTCTTGGATTTATAG
TACCTTATACTAAGGTTAAAAAAATATGCTTGATATTGTGAAAAGGTGAAATTCTTCACCAACATTTCATTTGCT
CCTTTGTCATATTGTAATGCCAATATAATATAGTTAATGAAAACAGCATTTTAAAAACCGAAATATTGAAATGG
TGTAATGTTGTACCATTTGCACTGTGAGCAAATGCTAATACAGTAAATATATTGTGTTTGCTGACAATCAAAAAA
AAAAAAAAAAAAA
```

FIGURE 323

MTGKLAEKLPVTMSSLLNQLPDNLYPEEIPSALNLFSGSSDSVVHYNQMATENVMDIGLTNEKPNPELSYSGSFQ
PAPGNKTVTYLGKFAFDSPSNWCQDNIISLMSAGILGVPPASGALSTQTSTASMVQPPQGDVEAMYPALPPYSNC
GDLYSEPVSFHDPQGNPGLAYSPQDYQSAKPALDSNLFPMIPDYNLYHHPNDMGSIPEHKPFQGMDPIRVNPPPT
TPLETIKAFKDKQIHPGFGSLPQPPLTLKPIRPRKYPNRPSKTPLHERPHACPAEGCDRRFSRSDELTRHLRIHT
GHKPFQCRICMRSFSRSDHLTTHIRTHTGEKPFACEFCGRKFARSDERKRHAKIHLKQKEKKAEKGGAPSASSAP
PVSLAPVVTTCA

FIGURE 324

```
CCCCAGCGAGGCTCCGGGAGCCCTTGCCTGCGGGGGTCCGGGGACTCGAGCCGGCCTCCGCCCCCGGACGCACA
GCCAGCGTGGTCCCCGCGTGCAACGCGAGCGCCGGGGAGTGGCTCCTGCTTTGCCCCTCGTGGGGGCCGAGCCAA
GACCAGTCTGCAAACTCCATCCCGCCGGCTGGAAGAAGTCGCGGAGCCGGCACCAAACCCGCAGCGTCTTCCCGC
GCGGATCCCGGGACTTAAAAAGCCGGGGCCACCCCGGCCCAGGACGGGATGCGGGTCGGTCCGGTGCGCTCTGCC
ATGAGCGGCGCCTCGCAGCCCCGCGGCCCGGCCCTGCTCTTCCCAGCCACCCGAGGCGTCCCGGCCAAACGCCTG
CTGGACGCCGACGACGCGGCGGCTGTGGCGGCCAAGTGCCCGCGCCTCTCCGAGTGCTCCAGCCCCCGGACTAC
CTCAGCCCCCCGGCTCGCCCTGCAGCCCGCAGCCCCGCCTGCCGCTCCGGGGCCGGCGGAGGCTCCGGGAGC
GCGCCGGGCCCAGCCGCATCGCCGACTACCTGCTGCTGCCCCTAGCCGAGCGCGAGCATGTGTCCCGGGCGCTG
TGCATCCACACTGGACGCGAGCTGCGCTGCAAGGTGTTTCCCATTAAACACTACCAGGACAAAATCAGGCCTTAC
ATCCAGCTGCCATCGCACAGCAACATTACTGGCATTGTGGAAGTGATCCTTGGGGAAACCAAGGCCTATGTCTTC.
TTTGAGAAGGACTTTGGGGACATGCACTCCTATGTGCGAAGCCGGAAGAGGCTGCGGGAAGAGGAAGCCGCCCGG
CTCTTCAAGCAGATTGTCTCCGCCGTCGCCCACTGCCACCAGTCAGCCATCGTGCTGGGGGACCTGAAGCTTAGG
AAGTTCGTCTTCTCCACGGAGGAGAGAACCCAGCTTAGACTAGAAAGTCTAGAAGACACACACATAATGAAGGGG
GAAGATGATGCTTTGTCAGACAAACATGGCTGCCCAGCCTACGTGAGCCCTGAGATCCTCAACACCACTGGGACC
TACTCCGGAAAGGCTGCGGACGTTTGGAGCCTGGGGGTGATGCTCTACACCCTTCTGGTTGGACGATACCCCTTC
CATGACTCAGACCCCAGTGCCCTTTTCTCCAAAATTCGGCGTGGACAGTTCTGCATTCCTGAGCACATTTCCCCC
AAAGCCAGGTGCCTCATTCGCAGCCTCTTGAGACGGGAGCCCTCCGAGAGACTCACTGCCCCCGAGATCCTACTG
CACCCCTGGTTTGAGTCCGTCTTGGAACCCGGGTACATCGACTCAGAAATAGGAACTTCAGACCAGATTGTTCCA
GAGTACCAGGAGGACAGTGACATTAGTTCCTTCTTCTGCTAATCCCCAAAACCTCAGAAACCTCATAATTCTTAA
CACCTGGCATTTCCATTTCTAAAGATGGACAGGCCCTTTGGCATGGTACCAACCAGATAATGACTGCATCAGGAT
GAAAGCTGCTGAACTCGGCATGGCGCCTCCTCTTCTCTGTTGGGATGAGTGACTTTATTGATTTGAGCAGCATAT
GCTGTGATTGGCTGCCCTGCAAATTTGTTTCCCTTAAGGAACCCTCACCAACTATCTCTGCTGGATTTGGGAGTT
CCGCATCTTTTGTGGAGGGCAGAGTATGGACATCTTACACCCGGTGGTCAAGTGTGTAATAAACTTGAGCATTCG
AATGGGAGAAAAAGCAAATCGCACAATGACATATTTTGAGTAATAACCGTATTTTTCACAGGGTGACAAATTGGG
CCAATAAATCTGCCATCTTTGAACTCATCTTTGGTGGCTAGACTGCTACGGCAGCTTCTCTGATGGGAAAGTTCC
TTTTTTGGCTTAACACTCACCCTTTCTTCACACTCACATTTACCAATGACTCTGCTCCGTTTTGGAGCAGACTG
TTTTAAGTTGCTCAGGAGCCTGATGGAACCATGAACCGAGACTCTTCTCTGTTTCCTGCCAAGACCTCATCTGCA
CTAATGCCTTCTCCCTGACCTTGACACTTCCCCCTTTAGCTATAAAAGCACTTACCAGCCGAACGTGGAACAGTA
TCACAAAAGATTCCATCTCCCAACGATTTCAGAACTCTGAGCTCAGAGAGACTCCAGATTTTAAAAAATAATTTG
AGTGCTTGGAAACTATTAGCTTTTTAAGTTCCTTCCAAATATGTTAGTACCTACCCTTTACTTTTTCCCCAAGAC
CATCTCAGGGTGGAGCATTCTGTCTAAGAGAAGAAAGATAAGGAGGCTCCCACCCACCTCTCCCAAGAGCAGACA
TTAAACATCTTTGTGCTTTGAAGAGAGTGAATTTGGATAGTCTTGTGATTCTCAGACTAACTTCCAGAATTATA
CTTTAACCCCTCCCAGATATGGTCCGCCTTTGGCATTGTGTGTACATCTGCAGTTTTGCATGGTGGGTTGTTAAT
ATTTCAAATGTGTGGTTTATGAATACGTCTGTATAATCGGCTTCTGGAGTGAAACAGCAAACCCCAAATCTTCAA
AGTTGGAAGGAACTTTAAAAATCATCCGGTCCAATCTCTTTCCTCTTTCTGCCACCTCCCAAGGCAGAAATCCCC
TCTTCAGCTTCTTTTGTAGGTGGGAATCCAGCCTCTGTTAGATATGTCCAGAGATGGAAACTCACTCCCCTACAA
AAGATGGAGCTTAATGGAGAAATTGCAACTTTCATTAAAAAACAAATTCAGATGAAATATCAGTAACTGTCTTGG
ACAGTGCTGAAATCAGGTGGTTAAACGGGTAAACAAAATATACTGTATTTTGAGAAATGGCACAAAAACAGGCAG
TCATCTTTAAGGGCTATGCCTAGGCAAACTACTAACATGCATTGTGAGAATGCCGTGTATACCTCACGTACTGTG
TACTTTGTACATATATTTTACCTTTTATACCTATGTTCGATTTTGTTTTGTTTGTTCTGGCTTTGAGGCTTGTT
TTGTTGTCTGTGTCTGTCTGAATAACCTGCGTGTCTAAAACCACGTGAAATGTGAATGATTATTGGCAATATTAC
CTTGACAGAATCATGGGACTTTGAGAAGAGGGAGGACAGAGGCCTCTGTCGCACTAACGCTCTCGTGGTTGCTCG
ACTGTTGTATCTGTGATACATTATCCGACTAAGGACTCTGGGCTGGCAGGGCCTTCTGCCGGGAAAGCTAGAAAC
ACTAGGTTCTTCCTGTACATACGTGTATATATGTGAACAGTGAGATGGCCGTTTCTGACTTGTAGAGAAATTTTA
ATAAACCTGGTTTCGTA
```

FIGURE 325

MRVGPVRSAMSGASQPRGPALLFPATRGVPAKRLLDADDAAAVAAKCPRLSECSSPPDYLSPPGSPCSPQPPPAA
PGAGGGSGSAPGPSRIADYLLLPLAEREHVSRALCIHTGRELRCKVFPIKHYQDKIRPYIQLPSHSNITGIVEVI
LGETKAYVFFEKDFGDMHSYVRSRKRLREEEAARLFKQIVSAVAHCHQSAIVLGDLKLRKFVFSTEERTQLRLES
LEDTHIMKGEDDALSDKHGCPAYVSPEILNTTGTYSGKAADVWSLGVMLYTLLVGRYPFHDSDPSALFSKIRRGQ
FCIPEHISPKARCLIRSLLRREPSERLTAPEILLHPWFESVLEPGYIDSEIGTSDQIVPEYQEDSDISSFFC

FIGURE 326

```
AGATGGAGTCTTGCTCTGTCACCCAGGCTGGAGTGCAGTGGTGTGATCTTGGCTCACTGCAACCTCTGCCTCCCA
GGTTCAAGCAATTCTCCTGCCTTAGCCTCCAGAGTAGCTGAGAATACAGGCACACACCACCACATTTGGCTAATT
TTTTTATTTTTAGTAGAGACTGGCTATCACCATGTTGGCCAGGCTGATCTTGAACTCCTGACCTCAAGTGATCCA
CATGCCTCTGCCTCCCAAAGTGCTGGGATTATAGGTGTGAGTCACTGTGCCTGACAAATATAAGCCTTTAAAGAG
AAGAAGGTTTTCATTTTGAAGACAAACATTAGGTACATAAAGAGGGTTGTAGTGTCTTTACTTGTATCACAGATT
TTATTGTACACATTATGTACTAAAGGAAAATCCTGAAGCAGTGCTCAAACTTTGATCAACATCAGGGAGTTTATA
TTGGAGAAAAACTGCAAATGTAATATATTTGGAAAAACATTTTCAAAAACTACTGCTTAGAAAACACCAGGGGA
TTTATACTAAAATATATTTTTGCAGATGCAGTAAGTATAAAAGAAATTTAATCCAAAATTAAGTGTGTGTAAATA
TCAGAGAATTCACAGTAGAAATATCTAAGGCACTGACATTTTAGACATTGAACTAATCAGTGTGCTGAGTACAGA
AAATAATCCAAAATTAAAGTTGGTAGATAAATTATTTGTATATAACTTTAAAAGAGGTAGAAATATTTTAGTTA
TAATTACATTTAAAGTATACTTTTTCTTTGAAAAAATTACAAAATTTTTAAAAAGTGAATGATGTAATTCAACT
CAAATTACTTCATGCTTTTCATTCTATTCACATGTGAAAGCATGTGATCAATTGCTGCTTCATCAAAGATATGAG
ACATTCTTTTTGTTAGGTGGGCAATATTTTTACCTTTTCTATGGAAGAGTAAAGACATTACAATGTAGGATGC
ATGATAAAAATCTAAGTGGAGAGGCTCTTTGTGTTTAATTTATAATATTGAATGATGTATGAGGGAAGTGTTCAG
AGGAATATTCTGCATTCTAGTGAAAATATCTTTTATTTTAGTTAAAATTAAATTAAAATTAGTAGTATATCTTTT
TACTAACTACTTTTATGTAATAAAATGCAGCACATTTAAAAAATTTTAGATTATTGTGAACTTAATTTTTAATT
AAACTTTTTTTTAACATGTTAAGACCAATGGTGCATTCAGTGAAGTATTATCATGCCATAATTCAACTATTCCA
CCTTACTCAAGGGTGTGGGTAAAAGATAGTAACCAATGTACTATTAATAACAGAGTGGCTAACATCTCTAATAAT
TCTCTTGCAAGGACTTTAACTAAGAACTTATTAAGAACATTGGTCCATAGGTAAATTTA
```

FIGURE 327

GGGAATAGCAGAATAGGAGCAAGCCAGCACTAGTCAGCTAACTAAGTGACTCAACCAAGGCCTTTTTCCTTGTT
ATCTTTGCAGATACTTCATTTTCTTAGCGTTTCTGGAGATTACAACATCCTGCGGTTCCGTTTCTGGGAACTTTA
CTGATTTATCTCCCCCCTCACACAAATAAGCATTGATTCCTGCATTTCTGAAGATCTCAAGATCTGGACTACTGT
TGAAAAAATTTCCAGTGAGGCTCACTTATGTCTGTAAAG<u>ATG</u>GGAAAAAAATACAAGAACATTGTTCTACTAAAA
GGATTAGAGGTCATCAATGATTATCATTTTAGAATGGTTAAGTCCTTACTGAGCAACGATTTAAAACTTAATTTA
AAAATGAGAGAAGAGTATGACAAAATTCAGATTGCTGACTTGATGGAAGAAAAGTTCCGAGGTGATGCTGGTTTG
GGCAAACTAATAAAAATTTTCGAAGATATACCAACGCTTGAAGACCTGGCTGAAACTCTTAAAAAAGAAAAGTTA
AAAGTAAAAGGACCAGCCCTATCAAGAAAGAGGAAGAAGGAAGTGCATGCTACTTCACCTGCACCCTCCACAAGC
AGCACTGTCAAAACTGAAGGAGCAGAGGCAACTCCTGGAGCTCAGAAAAGAAAAAAATCAACCAAAGAAAAGGCT
GGACCCAAAGGGAGTAAGGTGTCCGAGGAACAGACTCAGCCTCCCTCTCCTGCAGGAGCCGGCATGTCCACAGCC
ATGGGCCGTTCCCCATCTCCCAAGACCTCATTGTCAGCTCCACCCAACAGTTCTTCAACTGAGAACCCGAAAACA
GTGGCCAAATGTCAGGTAACTCCCAGAAGAAATGTTCTCCAAAAACGCCCAGTGATAGTGAAGGTACTGAGTACA
ACAAAGCCATTTGAATATGAGACCCCAGAAATGGAGAAAAAATAATGTTTCATGCTACAGTGGCTACACAGACA
CAGTTCTTCCATGTGAAGGTTTTAAACACCAGCTTGAAGGAGAAATTCAATGGAAAGAAAATCATCATCATATCA
GATTATTTGGAATATGATAGTCTCCTAGAGGTCAATGAAGAATCTACTGTATCTGAAGCTGGTCCTAACCAAACG
TTTGAGGTTCCAAATAAAATCATCAACAGAGCAAAGGAAACTCTGAAGATTGATATTCTTCACAAACAAGCTTCA
GGAAATATTGTATATGGGGTATTTATGCTACATAAGAAAACAGTAAATCAGAAGACCACAATCTACGAAATTCAG
GATGATAGAGGAAAAATGGATGTAGTGGGGACAGGACAATGTCACAATATCCCCTGTGAAGAAGGAGATAAGCTC
CAGCTTTTCTGCTTTCGACTTAGAAAAAAGAACCAGATGTCAAAACTGATTTCAGAAATGCATAGTTTTATCCAG
ATAAAGAAAAAACAAACCCGAGAAACAATGACCCCAAGAGCATGAAGCTACCCCAGGAACAGCGTCAGCTTCCA
TATCCTTCAGAGGCCAGCACAACCTTCCCTGAGAGCCATCTTCGGACTCCTCAGATGCCACCAACAACTCCATCC
AGCAGTTTCTTCACCAAGAAAAGTGAAGACACAATCTCCAAAATGAATGACTTCATGAGGATGCAGATACTGAAG
GAAGGGAGTCATTTTCCAGGACCGTTCATGACCAGCATAGGCCCAGCTGAGAGCCATCCCCACACTCCTCAGATG
CCTCCATCAACACCAAGCAGCAGTTTCTTAACCACGTTGAAACCAAGACTGAAGACTGAACCTGAAGAAGTTTCC
ATAGAAGACAGTGCCCAGAGTGACCTCAAAGAAGTGATGGTGCTGAACGCAACAGAATCATTTGTATATGAGCCC
AAAGAGCAGAAGAAAATGTTTCATGCCACAGTGGCAACTGAGAATGAAGTCTTCCGAGTGAAGGTTTTTAATATT
GACCTAAAGGAGAAGTTCACCCCAAAGAAGATCATTGCCATAGCAAATTATGTTTGCCGCAATGGGTTCCTGGAG
GTATATCCTTTCACACTTGTGGCTGATGTGAATGCTGACCGAAACATGGAGATCCCAAAAGGATTGATTAGAAGT
GCCAGCGTAACTCCTAAAATCAATCAGCTTTGCTCACAAACTAAAGGAAGTTTTGTGAATGGGGTGTTTGAGGTA
CATAAGAAAAATGTAAGGGGTGAATTCACTTATTATGAAATACAAGATAATACAGGGAAGATGGAAGTGGTGGTG
CATGGACGACTGAACACAATCAACTGTGAGGAAGGAGATAAACTGAAACTCACCAGCTTTGAATTGGCACCGAAA
AGTGGGAATACCGGGGAGTTGAGATCTGTAATTCATAGTCACATCAAGGTCATCAAGACCAGGAAAAACAAGAAA
GACATACTCAATCCTGATTCAAGTATGGAAACTTCACCAGACTTTTTCTTC<u>TAA</u>AATCTGGATGTCATTGACGAT
AATGTTTATGGAGATAAGGTCTAAGTCCCTAAAAAAATGTACATATACCTGGTTGAAATACAACACTATACATAC
ACACCACCATATATACTAGCTGTTAATCCTATGGAATGGGGGTATTGGGAGTGCTTTTTAATTTTTCATAGTTT
TTTTTTAATAAAATGGCATATTTTGCATCTACAACTTCTATAATAAGAAAAAATAAATAAACATTATCTTTTTG
TGAAAAAAA

FIGURE 328

MGKKYKNIVLLKGLEVINDYHFRMVKSLLSNDLKLNLKMREEYDKIQIADLMEEKFRGDAGLGKLIKIFEDIPTL
EDLAETLKKEKLKVKGPALSRKRKKEVHATSPAPSTSSTVKTEGAEATPGAQKRKKSTKEKAGPKGSKVSEEQTQ
PPSPAGAGMSTAMGRSPSPKTSLSAPPNSSSTENPKTVAKCQVTPRRNVLQKRPVIVKVLSTTKPFEYETPEMEK
KIMFHATVATQTQFFHVKVLNTSLKEKFNGKKIIISDYLEYDSLLEVNEESTVSEAGPNQTFEVPNKIINRAKE
TLKIDILHKQASGNIVYGVFMLHKKTVNQKTTIYEIQDDRGKMDVVGTGQCHNIPCEEGDKLQLFCFRLRKKNQM
SKLISEMHSFIQIKKKTNPRNNDPKSMKLPQEQRQLPYPSEASTTFPESHLRTPQMPPTTPSSSFFTKKSEDTIS
KMNDFMRMQILKEGSHFPGPFMTSIGPAESHPHTPQMPPSTPSSSFLTTLKPRLKTEPEEVSIEDSAQSDLKEVM
VLNATESFVYEPKEQKKMFHATVATENEVFRVKVFNIDLKEKFTPKKIIAIANYVCRNGFLEVYPFTLVADVNAD
RNMEIPKGLIRSASVTPKINQLCSQTKGSFVNGVFEVHKKNVRGEFTYYEIQDNTGKMEVVVHGRLNTINCEEGD
KLKLTSFELAPKSGNTGELRSVIHSHIKVIKTRKNKKDILNPDSSMETSPDFFF

FIGURE 329

GTTTGAAACGTACCTGCATGCAAACTATTCTAGGACAACTCAAGTTTTAGCTGCTCTGTGTGCGTTGTGTATGGG
AGTCATCTGAAGTGTTTTTCCTGTGTTGTTCACAACCCGTTAAGCCCCTGGGATAAAGCTGATTAAAACTGGGAT
TCCCCAGGGTACCCCCGTCCAGCCTGTTAGCCAAGTTACAAGCTTTTCTCAGAGAAGCCCCCCGGGCTTGTGCCC
ACCAGCATTCTGCTCTGTCCGGGTGAGTAACTCATATTTCTTTNTTTCTCCTTTTTTTTTCTCCTAAACTTTCCA
GGTAAAAGTACACCTGTAAGGCCAGCTTGGTTCCGCAGACTTTCCCGAGGCCCCGATCCATTCCAGCCACTCGG
GGCTGACAGCGGCGACCCGTTCCAAAGTAAAAAGGGGTTTGGGGACCCGTTTAGTGGAAAAGACCCATTTGTCCC
CTCCTCTGCAGCTAAACCTTCTAAGGCCTCTGCCTCGGGCTTTGCAGACTTCACCTCTTTTGGCAATGAGGAGCA
GCAGCTGGCGTGGGCCAAGCGGGAGAGCGAGAAGGCGGAACAGGAGAGGCTGGCGCGGCTGCGGCGGCAGGAGCA
GGAGGACCTGGAACTGGCCATCGCGCTCAGCAAGGCTGACATGCCTGCCGCCTAGGCGAGGGCCGTGTGTAGGCG
GGACAGGGCACGGGCGGGTTCCAGAGAGGGGGCAGTGCAGATGTCTATATATACACACACACACCGTCGCCACCG
TACTCCAAGGACCGGGACTCGGGGGCTTGTTCAGGGTGAGCAGACTCGGCTGCAAGACCTGGAAAGGTCACATCT
CCTGGGAAGCCCTTACAGAGGCCTTGGCCACCACTTCTGCAGGTCCGTCTCTCCACTGTGCCATCCCCCCCGGG
GCTGACTGCCTCCCGCTCTTCCTCTGGGGACGAACACACAGCGGTCAGTCGAGGAGAG

FIGURE 330

MRSSSWRGPSGRARRRNRRGWRGCGGRSRRTWNWPSRSARLTCLPPRRGPCVGGTGHGRVPERGQCRCLYIHTHT
VATVLQGPGLGGLFRVSRLGCKTWKGHISWGSPYRGLGHHFCRSVSPLCHPPRG

FIGURE 331

CCTTGAGCTCCTCCTCGCCCTTCTCCAACCGGCCTCCCCTGCCGCCTACCCCCAGCAGGGCCTTGGATGACAAAC
CCCTCCACCACCTCCTCCAGTGGGCAACAGGCCCTCCTCCTCCTCAGAACAACAAGCCTCCAGTGCCTTCCACT
CCGCGGCCTTCGGCCTCCTCACAGGCCCCAACTTCGGCGGCCACCTCCCAGCAGGCCCGGGCCGCCTCCTCTGCC
TCCAAGTTCCAGCGGCAATGACGAAACCCCAAGACTCCCACAGCGGAATCTGTCCCTCAGTTCGTCCACGCCCCC
GTTACCTTCGCCAGGACGTTCAGGTCCTCTTCCTCCCCCGCCCAGTGAGAGACCCCCACCTCCAGTGAGGGACCC
GCCAGGCCGATCAGGTATGACAAGACGTGGAGTGAGTTGCTTCCAAAACCCAGCCTGCCCAAATGTACCAATAAT
CCTGTCAGTCAAGATAGTCTAACAAAAGCAGGCATAAGTAAACTCAGACTGCTTTGTGCTTTTAAGTGGCACACG
ACACGTGTGATCGTGACCTCGTGTAAACCCGGGGGAAAGTGGGACCAATATTTCTGTTGGTGTTTTAGAGATGA
GGACACTGAGTAGCTAATAAAGTTAAATGGTCACGAGCTAGTTAATAAAGAAGAGGCAAGAACTTTCATCTTCCA
TCTCTGAAGTGTACTTGCCAGTCCACTACCCTGCCTCCCTAGAGAGAATTTCGGCGGTCTTAATTGGGAAAATAA
GTCCCCACCTCCCGCAGGAGGGCTCTGTTATTCCAACAAGAGGGGAAGTTCTTCAAGAGCTAATGAACTTCTCCT
GTACTTCTCTCTTCATTCGCCAGGCTTTGAGGCCATTTCCCTATTCATTAAAGACTAATGTTTAAAAAGTCAAAA
AA

FIGURE 332

LSSSSPFSNRPPLPPTPSRALDDKPPPPPPPVGNRPSSSSEQQASSAFHSAAFGLLTGPNFGGHLPAGPGRLLCL
QVPAAMTKPQDSHSGICPSVRPRPRYLRQDVQVLFLPRPVRDPHLQ

FIGURE 333

```
AGCCTACGCACGAAAGTGACTAGGGAGGAAGGATATTATAAAGTGATGCAAACAGAAATTCCACCAGCCTCCATG
TATCATCATGTGTCATAACTCAGTCAAGCTCAGTGAGCATTCTCAGCACATTGCCTCAACAGCTTCAAGGTGAGC
CAGCTCAAGACTTTGCTCTCCACCAGGCAGAAGATGACAGACTGTGAATTTGGATATATTTACAGGCTGGCTCAG
GACTATCTGCAGTGCGTCCTACAGATACCACAACCTGGATCAGGTCCAAGCAAAACGTCCAGAGTGCTACAAAAT
GTTGCGTTCTCAGTCCAAAAAGAAGTGGAAAAGAATCTGAAGTCATGCTTGGACAATGTTAATGTTGTGTCCGTA
GACACTGCCAGAACACTATTCAACCAAGTGATGGAAAAGGAGTTTGAAGACGGCATCATTAACTGGGGAAGAATT
GTAACCATATTTGCATTTGAAGGTATTCTCATCAAGAAACTTCTACGACAGCAAATTGCCCCGGATGTGGATACC
TATAAGGAGATTTCATATTTTGTTGCGGAGTTCATAATGAATAACACAGGAGAATGGATAAGGCAAAACGGAGGC
TGGGAAAATGGCTTTGTAAAGAAGTTTGAACCTAAATCTGGCTGGATGACTTTTCTAGAAGTTACAGGAAAGATC
TGTGAAATGCTATCTCTCCTGAAGCAATACTGTTGACCAGAAAGGACACTCCATATTGTGAAACCGGCCTAATTT
TTCTGACTGATATGGAAACGATTGCCAACACATACTTCTACTTTTAAATAAACAACTTTGATGATGTAACTTGAC
CTTCCAGAGTTATGGAAATTTTGTCCCCATGTAATGAATAAATTGTATGTATTTTCTCT
```

FIGURE 334

MTDCEFGYIYRLAQDYLQCVLQIPQPGSGPSKTSRVLQNVAFSVQKEVEKNLKSCLDNVNVVSVDTARTLFNQVM
EKEFEDGIINWGRIVTIFAFEGILIKKLLRQQIAPDVDTYKEISYFVAEFIMNNTGEWIRQNGGWENGFVKKFEP
KSGWMTFLEVTGKICEMLSLLKQYC

FIGURE 335

```
CTGAGGCCCACGCAGGGCCTAGGGTGGGAAGATGGCAGGTGGGGGCGGCGACCTGAGCACCAGGAGGCTGAATGA
ATGTATTTCACCAGTAGCAAATGAGATGAACCATCTTCCTGCACACAGCCACGATTTGCAAAGGATGTTCACGGA
AGACCAGGGTGTAGATGACAGGCTGCTCTATGACATTGTATTCAAGCACTTCAAAAGAAATAAGGTGGAGATTTC
AAATGCAATAAAAAAGACATTTCCATTCCTCGAGGGCCTCCGTGATCGTGATCTCATCACAAATAAAATGTTTGA
AGATTCTCAAGATTCTTGTAGAAACCTGGTCCCTGTACAGAGAGTGGTGTACAATGTTCTTAGTGAACTGGAGAA
GACATTTAACCTGCCAGTTCTGGAAGCACTGTTCAGCGATGTCAACATGCAGGAATACCCCGATTTAATTCACAT
TTATAAAGGCTTTGAAAATGTAATCCATGACAAATTGCCTCTCCAAGAAAGTGAAGAAGAAGAGAGGGAGGAGAG
GTCTGGCCTCCAACTAAGTCTTGAACAAGGAACTGGTGAAAACTCTTTTCGAAGCCTGACTTGGCCACCTTCGGG
TTCCCCATCTCATGCTGGTACAACCCCACCTGAAAATGGACTCTCAGAGCACCCCTGTGAAACAGAACAGATAAA
TGCAAAGAGAAAAGATACAACCAGTGACAAAGATGATTCGCTAGGAAGCCAACAAACAAATGAACAATGTGCTCA
AAAGGCTGAGCCAACAGAGTCCTGCGAACAAATTGCTGTCCAAGTGAATAATGGGGATGCTGGAAGGGAGATGCC
CTGCCCGTTGCCCTGTGATGAAGAAGCCCAGAGGCAGAGCTACACAACCATGGAATCCAAATTAATTCCTGTTC
TGTGCGACTGGTGGATATAAAAAAGGAAAAGCCATTTTCTAATTCAAAAGTTGAGTGCCAAGCCCAAGCAAGAAC
TCATCATAACCAGGCATCTGACATAATAGTCATCAGCAGTGAGGACTCTGAAGGATCCACTGACGTTGATGAGCC
CTTAGAAGTCTTCATCTCAGCACCGAGAAGTGAGCCTGTGATCAATAATGACAACCCTTTAGAATCAAATGATGA
AAAGGAGGGCCAAGAAGCCACTTGCTCACGACCCCAGATTGTACCAGAGCCCATGGATTTCAGAAAATTATCTAC
ATTCAGAGAAAGTTTTAAGAAAAGAGTGATAGGACAAGACCACGACTTTTCAGAATCCAGTGAGGAGGAGGCGCC
CGCAGAAGCCTCAAGCGGGGCACTGAGAAGCAAGCATGGTGAGAAGGCTCCTATGACTTCTAGAAGTACATCTAC
TTGGAGAATACCCAGCAGGAAGAGACGTTTCAGCAGTAGTGACTTTTCAGACCTGAGTAATGGAGAAGAGCTTCA
GGAAACCTGCAGCTCATCCCTAAGAAGAGGGTCAGGTAAAGAAGATTAGGATGCCAAGACTTGGCCTGCAGAATG
TCAGGAATGTGAATTAAAAGCTGCTGTTTCCAGACGCTTTTATTCTGAGCACCTTCACTACCTTGTATCCAGTT
CATCTGGGAACTCCTTTTTGCATTTTAGAAAATGGAAAGAGGCAGGAAATTATGATAAACTCATGTTTAACAGAA
AGAGTTTCACTGACTAAATGTATGTAATTATATTTTGTTGTTGTAGAAGAAATAAATAGCAAATTTGTGGTATTC
TTTTTTTTAAACCTGCTCTCATTCCTATTAACACTAAGATCTTAGATTTTTATAGTGATAAATGGGTTGACATCA
TTGTCGTTTGTAATTGTAAAGCCTCAAAAGACAACTGTTCCTACTATGTAATTATAGACAGAAATAAAAACTTCA
GATC
```

FIGURE 336

```
MAGGGGDLSTRRLNECISPVANEMNHLPAHSHDLQRMFTEDQGVDDRLLYDIVFKHFKRNKVEISNAIKKTFPFL
EGLRDRDLITNKMFEDSQDSCRNLVPVQRVVYNVLSELEKTFNLPVLEALFSDVNMQEYPDLIHIYKGFENVIHD
KLPLQESEEEEREERSGLQLSLEQGTGENSFRSLTWPPSGSPSHAGTTPPENGLSEHPCETEQINAKRKDTTSDK
DDSLGSQQTNEQCAQKAEPTESCEQIAVQVNNGDAGREMPCPLPCDEESPEAELHNHGIQINSCSVRLVDIKKEK
PFSNSKVECQAQARTHHNQASDIIVISSEDSEGSTDVDEPLEVFISAPRSEPVINNDNPLESNDEKEGQEATCSR
PQIVPEPMDFRKLSTFRESFKKRVIGQDHDFSESSEEEAPAEASSGALRSKHGEKAPMTSRSTSTWRIPSRKRRF
SSSDFSDLSNGEELQETCSSSLRRGSGKED
```

FIGURE 337

```
GAGTGTTTGGGTTTCTTCGCGGCTGCTCAAGATGAACCGACTCTTCGGGAAAGCGAAACCCAAGGCTCCGCCGCC
CAGCCTGACTGACTGCATTGGCACGGTGGACAGTAGAGCAGAATCCATTGACAAGAAGATTTCTCGATTGGATGC
TGAGCTAGTGAAGTATAAGGATCAGATCAAGAAGATGAGAGAGGGTCCTGCAAAGAATATGGTCAAGCAGAAAGC
CTTGCGAGTTTTAAAGCAAAAGAGGATGTATGAGCAGCAGCGGGACAATCTTGCCCAACAGTCATTCAACATGGA
ACAAGCCAATTATACCATCCAGTCTTTGAAGGACACCAAGACCACGGTTGATGCTATGAAACTGGGAGTAAAGGA
AATGAAGAAGGCATACAAGCAAGTGAAGATCGACCAGATTGAGGATTTACAAGACCAGCTAGAGGATATGATGGA
AGATGCAAATGAAATCCAAGAAGCACTGAGTCGCAGTTATGGCACCCCAGAACTGGATGAAGATGATTTAGAAGC
AGAGTTGGATGCACTAGGTGATGAGCTTCTGGCTGATGAAGACAGTTCTTATTTGGATGAGGCAGCATCTGCACC
TGCAATTCCAGAAGGTGTTCCCACTGATACAAAAAACAAGGATGGAGTTCTGGTGGATGAATTTGGATTGCCACA
GATCCCTGCTTCATAGATTTGCATCATTCAAGCATATCTTGTAAAACAAACACATATTATGGGACTAGGAAATAT
TTATCTTTCCAAATTTGCCATAACAGATTTAGGTTTCTTTCCTTTCTTTGAAGGAAAGTTTAATTACATTGCTCT
TTTATTTTTTCCATTAAGAGACTCATTGCTTGGGAAATGCTTTCTTCGTACTAAAATTTGATTCCTTTTTTTCTT
ATGAAAAACGAACTCAGTTTAAAAGTATTTTTAGCTCGTATGACTTGTTTTCATTCATTAATAATAATTTGAAAT
AAAACTAAGGAAATGGAATCTTAAAAGTCTATGACAGTGTAACTCTACAGTCTCAAAATGACCTGATAAATTGAT
AAGACAAAGATGAGATTATTGGGGCTGTTCATATTATGATTCAGAATCATTTTCTATTGTGGTATTATAGGTTGG
TTAAAGTGATGGCCTTTTTGATGGGTTTTGTTGTGTCTTGTGAACAAGTCGTTACTGTGTCCATTATTGGAATGG
AATTATCACTACTGTATCATGAGTGGGTATTTGATTCTATGGTTCCCTCAGTATTACATCTTGACTTGTAATCA
ATTATGAATATTCTTGATATTTAATGTATAGGACATTTATTTATACTCAATAAATATTTTCAAAAGGAAAAAA
AAAAAAAAAAAAAAAAAAAAAAAA
```

FIGURE 338

MNRLFGKAKPKAPPPSLTDCIGTVDSRAESIDKKISRLDAELVKYKDQIKKMREGPAKNMVKQKALRVLKQKRMY
EQQRDNLAQQSFNMEQANYTIQSLKDTKTTVDAMKLGVKEMKKAYKQVKIDQIEDLQDQLEDMMEDANEIQEALS
RSYGTPELDEDDLEAELDALGDELLADEDSSYLDEAASAPAIPEGVPTDTKNKDGVLVDEFGLPQIPAS

FIGURE 339

```
AAACATTCTGACAAAATAGGTGAAACAGCAATGAAACAGGCACAGCATCAGAAAACCTTCAGTGTTTCTCTGCAG
AAACAAAATAAAATGAAATTTGGGAAAAATATGTATATAAATCGTGATAGAATTCCAGAGGAAAGGAATGAAACT
GTATTGAAACATTCACTTGAAGAAGAGGATGAGAATGAAGAAGAGATCTTAACTGTTCAGGATCTTGTTGATTTT
TCCCCTGTTTATCGATGTTTGCACATTTATTCTGTTTTGGGTGACGAGGAAACATTTGAAAACTATTATCGAAAA
CAAAGAAAGAAACAAGCAAGACTGGTATTGCAACCCCAGTCGAATATGCATGAAACAGTTGATGGCTATAGAAGA
TATTTCACTCAAATTGTAGGGTTCTTTGTGGTAGAAGATCACATTTTACATGTGACCCAAGGATTAGTAACCAGG
GCATACACTGATGAACTTTGGAACATGGCCCTCTCAAAGATAATTGCTGTCCTTAGAGCTCATTCATCCTATTGC
ACTGATCCTGATCTTGTTCTGGAGCTGAAGAATCTTACTGTAATATTTGCAGATACTTTACAGGGTTATGGTTTT
CCAGTGAACCGACTTTTTGACCTTTTATTTGAAATAAGAGACCAATACAATGAAACACTGCTTAAGAAATGGGCT
GGAGTTTTCAGGGACATTTTTGAAGAAGATAATTACAGCCCCATCCCTGTTGTCAATGAAGAAGAATATAAAATT
GTCATCAGCAAATTTCCCTTTCAAGATCCAGACCTTGAAAAGCAGTCTTTCCCAAAGAAATTCCCCATGTCTCAG
TCAGTGCCTCATATTTACATTCAAGTTAAAGAATTTATTTATGCCAGCCTTAAATTTTCAGAGTCACTACACCGG
AGCTCAACAGAAATAGACGATATGCTTAGAAAATCAACAAATCTGCTGCTGACCAGAACTTTGAGTAGCTGTTTA
CTGAACCTTATTAGAAAACCTCATATAGGTTTGACAGAGCTGGTACAAATCATCATAAACACAACACACCTGGAG
CAAGCTTGTAAATATCTTGAGGACTTTATAACTAACATTACAAATATTTCCCAAGAAACTGTTCATACTACAAGA
CTTTATGGACTTTCTACTTTCAAGGATGCTCGACATGCAGCAGAAGGAGAAATATATACCAAACTGAATCAAAAA
ATTGATGAATTTGTTCAGCTTGCTGATTATGACTGGACAATGTCTGAGCCAGATGGAAGAGCTAGTGGTTATTTA
ATGGACCTTATAAATTTTTTGAGAAGCATCTTTCAAGTGTTTACTCATTTGCCTGGGAAAGTTGCTCAGACAGCT
TGCATGTCAGCCTGCCAGCATCTGTCAACATCCTTAATGCAGATGCTACTGGACAGTGAGTTAAAACAAATAAGC
ATGGGAGCTGTTCAGCAGTTTAACTTAGATGTCATACAGTGTGAATTGTTTGCCAGCTCTGAGCCTGTGCCAGGA
TTCCAGGGGGATACCCTGCAGCTAGCATTCATTGACCTCAGACAACTCCTTGACCTGTTTATGGTTTGGGATTGG
TCTACTTACCTAGCTGATTATGGGCAGCCAGCTTCTAAGTACCTTCGGGTGAATCCAAACACAGCCCTTACTCTT
TTGGAGAAGATGAAGGATACTAGCAAAAAGAACAATATATTTGCTCAGTTCAGGAAGAATGATCGAGACAAACAG
AAGTTGATAGAGACAGTCGTGAAACAGCTGAGAAGTTTGGTGAATGGTATGTCCCAGCACATGTAGACCTCACAT
GGCTTGCACTCAGTGACACCAAATCCATGATTCAATGTTGATCTTGAGCAAGTATTGGTCATGATACAGTAATTT
GTTTACAGAATCCAAAAATACAATAGAGAAGATACATGAGGGCTTAAACAAGAAATAGTAATAAATATCATTTGT
ATGGATTTTTAAATAATCGAATACTATTTTATATATGGAAAAAAATGACCATTTTTTCACTTTTAGGGGAAAATG
CAAAAGGTGTAATACATAAATTGTCACAAATTATACCTGAAATTGATTACAAATACATTTGAAAAACATATGCCT
CTACTCATAAGTATTTTTTTCTATTTAGACTTGAATGATAATCTGTTTTTTGATCAGTATATGGCTTTGGAATTC
AATCATGTCTGATATGGTAGTATTTCACTACCATTTCTGACTTTTAGCTTTTATTTTCACCTCAATGTGATTTA
AGCAGACCAAAATTTCTAATTCTGCTAATTCTGAAGGGGAAATAGACAAATCTTAAAAGCTGCCTGAAATCAAAC
TTGATTTAACTCAGTAAGAATGTGAATTATTTGTTCTACTTGGGTGGTTTAATTTAATCGTTCTGAATATGAACA
AAAGGTTTTGGATTTTCTAAAGATGCAGTGTTGTTTCTGTTCATCAGGGTTAATATTTCTAACTATATTGCTTGT
AGGTGACCCCATTCTGGATTTGTTTGGTTTGGTTTGGTTCCAGTTAAAAGAGAGGACAGGAACTAAATGGGGCTA
ACCACTTCAGGTGCAGCTTGTGCGAGGGTAGATGGTTCCTGCACACAGAAGTTACCACAGGGGTCAGGTTACTTT
CTTCAAATAGCAGATTTCAGTACTTTATCCTCATTGTGGAAACAAGCCAAACCAAATGAACTCTGGAAAACCTAA
AACAAATGTACATTTTCCTTTGTGTATGTTTCTGTGGTCCAAATGGCAATATAAATCCAGTCTTTATTCTCCCTT
TGTTGTATTTATGCTGAATCTTCCCTTTGCCTTTTCAGGATTTAGGCCTGTAAGAAACTATGCCTGATTCTGTAA
AATAAGTGTAAAGAATTATATGTACATCTCTGGATTTTGTGATGAAATATTAAAAATATTGAGCAAGTTGTTAAA
AAAAAAAAAAAAAAA
```

FIGURE 340

```
AAAGATGAAGAGAGCAGGATTTGTAAAGCCCTGTTTTTATACACTTCACATTTGCGGAAATATAATGATGCCCTC
ATTATCAGTGAGCATGCACGAATGAAAGATGCTCTGGATTACTTGAAAGACTTCTTCAGCAATGTCCGAGCAGCA
GGATTCGATGAGATTGAGCAAGATCTTACTCAGAGATTTGAAGAAAAGCTGCAGGAACTAGAAAGTGTTTCCAGG
GATCCCAGCAATGAGAATCCTAAACTTGAAGACCTCTGCTTCATCTTACAAGAAGAGTACCACTTAAACCCAGAG
ACAATAACAATTCTCTTTGTGAAAACCAGAGCACTTGTGGACGCTTTAAAAAATTGGATTGAAGGAAATCCTAAA
CTCAGTTTTCTAAAACCTGGCATATTGACTGGACGTGGCAAAACAAATCAGAACACAGGAATGACCCTCCCGGCA
CAGAAGTGTATATTGGATGCATTCAAAGCCAGTGGAGATCACAATATTCTGATTGCCACCTCAGTTGCTGATGAA
GGCATTGACATTGCACAGTGCAATCTTGTCATCCTTTATGAGTATGTGGGCAATGTCATCAAAATGATCCAAACC
AGAGGCAGAGGAAGAGCAAGAGGTAGCAAGTGCTTCCTTCTGACTAGTAATGCTGGTGTAATTGAAAAAGAACAA
ATAAACATGTACAAAGAAAAAATGATGAATGACTCTATTTTACGCCTTCAGACATGGGACGAAGCAGTATTTAGG
GAAAAGATTCTGCATATACAGACTCATGAAAAATTCATCAGAGATAGTCAAGAAAAACCAAAACCTGTACCTGAT
AAGGAAAATAAAAAACTGCTCTGCAGAAAGTGCAAAGCCTTGGCATGTTACACAGCTGACGTAAGAGTGATAGAG
GAATGCCATTACACTGTGCTTGGAGATGCTTTTAAGGAATGCTTTGTGAGTAGACCACATCCCAAGCCAAAGCAG
TTTTCAAGTTTTGAAAAAAGAGCAAAGATATTCTGTGCCCGACAGAACTGCAGCCATGACTGGGGAATCCATGTG
AAGTACAAGACATTTGAGATTCCAGTTATAAAAATTGAAAGTTTTGTGGTGGAGGATATTGCAACTGGAGTTCAG
ACACTGTACTCGAAGTGGAAGGACTTTCATTTTGAGAAGATACCATTTGATCCAGCAGAAATGTCCAAATGATAT
CAGGTCCTCAATCTTCAGCTACAGGGAATGAGTAACTTTGAGTGGAGAAGAAACAAACATAGTGGGTATAATCAT
GGATCGCTTGTACCCCTGTGAAAATATATTTTTAAAAATATCTTTAGCAGTTTGTACTATATTATATATGCAAA
GCACAAATGAGTGAATCACAGCACTGAGTATTTTGTAGGCCAACAGAGCTCATAGTACTTGGGAAAAATTAAAAA
GCCTCATTTCTAGCCTTCTTTTAGAGTCAACTGCCAACAAACACACAGTAATCACTCTGTACACACTGGGATAG
ATGAATGAATGGAATGTTGGGAATTTTTATCTCCCTTTGTCTCCTTAACCTACTGTAAACTGGCTTTTGCCCTTA
ACAATCTACTGAAATTGTTCTTTTGAAGGTTACCAGTGACTCTGGTTGCCAAATCCACTGGGCACTTCTTAACCT
TCTATTTGACCTCTGCGCATTTGGCCCTGTTGAGCACTCTTCTTGAAGCTCTCCCTGGGCTTCTCTCTCTTCTAG
TTCTATTCTAGTCTTTTTTATTGAGTCCTCCTCTTTGCTGATCCCTTCCAAGGGTTCAATATATATACATGTAT
ATACTGTACATATGTATATGTAACTAATATGCATACATACAGGTATGTATATGTAATGGTTATATGTACTCATGT
TCCTGGTGTAGCAACGTGTGGTATGGCTACACAGAGAACATGAGAACATAAAGCCATTTTGTGCTTACTACCAA
AGGCTGTCCACTGTAGAGTTGCTGTATGTAGCAATGTGTATCCACTCTACGGTGGTCAGCTTTTAGTAGAGAGCA
TAAAAATGATAAAATACTTCTTGAAAACTTAGTTTACTATACATCTTGCCCTATTAATATGTTCTCTTAACGTGT
GCCATTGTTCTCTTTGACCATTTTCCTATAATGATGTTGATGTTCAACACCTGGACTGAATGTCTGTTCTCAGAT
CCCTTGGATGTTACAGATGAGGCAGTCTGACTGTCCTTTCTACTTGAAAGATTAGAATATGTATCCAAATGGCAT
TCACGTGTCACTTAGCAAGGTTTGCTGATGCTTCAAAGAGCTTAGTTTGCGGTTTCCTGGACGTGGAAACAAGTA
TCTGAGTTCCCTGGAGATCAACGGGATGAGGTGTTACAGCTGCCTCCCTCTTCATGCAATCTGGTGAGCAGTGGT
GCAGGCGGGGAGCCAGAGAAACTTGCCAGTTATATAACTTCTCTTTGGCTTTTCTTCATCTGTAAAACAAGGATA
ATACTGAACTGTAAGGGTTAGTGGAGAGTTTTTAATTAAAAGAATGTGTGAAAAGTACATGACACAGTAGTTGCT
TGATAATAGTTACTAGTAGTAGTATTCTTACTAAGACCCAATACAAATGGATTATTTAAACCAAAAAAAAAAAAA
AAAAAAA
```

FIGURE 341

```
CTCTCTAGGCTGCCGGGCGCTGGTCGTCAGCGCCGAGGCTGGGCTGAGGCGCCGCGGTACCATGAGGCGCCGGTA
CTTAAGAGATTATGGCATCAGAAACCCACAATGTTAAAAAACGGAACTTTTGTAATAAGATTGAGGATCATTTCA
TTGATCTTCCTAGAAAAAAGATCTCTAATTTCACTAATAAGAACATGAAGGAGGTTAAGAAATCTCCAAAACAGT
TGGCTGCTTACATAAATAGAACAGTTGGACAAACTGTGAAAAGCCCAGATAAACTTCGTAAAGTGATCTATCGCA
GAAAGAAAGTTCATCATCCCTTTCCAAATCCTTGTTACAGAAAAAAACAGTCCCCTGGAAGTGGGGGCTGTGACA
TGGCAAATAAAGAAAATGAACTGGCTTGTGCAGGCCACCTGCCTGAAAAATTACACCATGATAGTCGAACATATT
TGGTTAACTCCAGTGATTCTGGTTCTTCACAGACAGAAAGCCCATCATCAAAATATAGTGGGTTTTTTTCTGAGG
TTTCTCAGGACCATGAAACAATGGCCCAAGTTTGTTCAGCAGGAATATGAGATTGAATGTAGCTTTAACTTTCT
GGAGAAAGAGAAGTATAAGTGAACTTGTAGCTTATTTGTTGAGGATAGAAGATCTTGGCGTTGTGGTAGATTGCC
TTCCTGTGCTCACCAATTGTTTACAGGAAGAAAAACAATATATCTCACTTGGCTGCTGTGTTGACTTGTTGCCTC
TAGTAAAGTCACTACTTAAAAGCAAATTTGAAGAATATGTTATAGTTGGTTTAAACTGGCTTCAAGCAGTCATTA
AAAGGTGGTGGTCAGAACTATCATCCAAAACAGAAATTATAAATGATGGAAATATTCAAATTTTAAAACAACAAT
TAAGTGGATTATGGGAACAGGAAAACCATCTTACTTTGGTTCCAGGATATACTGGTAATATAGCTAAGGATGTAG
ATGCTTATTTATTACAGTTACATTGAGAGATTTCATCTACTAAAGAGCATTTGGTTTTTCAAAACATCCCTGAAC
TGTATAATTTACAAAAAAAAAGTCTCGTCTGAGAACTGTGAACTGTGGAAGAAATCAAAACTATTTTTTCTTTT
AAAAAGCCACGTAATGAAACCACTAATGAAATCCCAGCAATCTGCTTCACATTGAAGTGGAAAAATATCCAAAAG
GAGCAGCTTCAATTTCATTGAGGTGAAAGTGCACTATGAAGATTGTTCACCTTTGCTGCATTTGGGAGTTATATG
GTTATTTGGTAACATTAAGAACTACTGGATTTTAATGCAATCCTGCATAAAAATATAATTTATACTATGTGAAAA
AATAAGACAGGACTTACCACTAGGAACCACCAAGACCAATCATCATTAACTTTTTAAGATTGTGTTTATTAAA
AAAAAAAAACACTTAAATGTGTGCAGCTATTTCTTATGTTGAAAAGACTGAAAGTTTAAAACATGAAAAAAATC
AATATTAAACATTTTTGTTCACACTGAGATACTGTGTATGTAAAATGCCTTAATTATTAATAAGCCAATGTGTT
ATGATACCAATATCTGTTTAAAAAACTAAAACCAACCATGCTTCTGGCATGATAAAATCATGGAATTAAATCAG
GGGTTTACATTCTTGTAGAGTGTTCTTGAAACACTCTCTGCACCATTTTAAAACTTGAGAATAGTTTTAGTATC
TCTGATATTTTTGCCAGAATCATCATGTCATGTATGAATGTGTTATCCCTATCTAAGGAAAAAGGTGAATATGT
TTTTGTATGAATGTTTAACTGGAAATGTCCATGGACTTGGCTAATTTATATTTACTTTTATTGTACATAGATTT
CTAATATTTTCATTCCTGTATCATTTAAACTTCCTTCATTTGAGTAAATTCACTAAATATTTCTATTTTTTGC
TTTTTTAAATTCTGATTTTATATGAATTCTAATTCTTTTTCACTACATATGTTTAAAGAGTTACATACAGTGAT
TTAGAATGGTTTACAGTTAATGCTGATCTTGTATTTTAAATTCCAACACTTTGTGTCACTACCTCCTCTAATGGT
TAGTATGATATGCTAGCAGACTGTATGAGGTCTTTTTTAAAATACCACTTTTAGTGTCAGTGAACCAAATTCTG
GAATGTCTTAACAGCTCTAAATCTTACTTGTCTTGAAAATGATTGGGGTTTAATACCACTGCTGGTGGTTCACAC
ATCATCCCATCCTTAATATGCCTGACAGGCATCTGAGCAAAGGTTTTAGTAATTGAATTTCTCTGCAGTAGTCC
TTCAAGCACTTGAATGTAAACCTTTAGCATTTATTCGTTTAATGACTACTGATACGAATCTCAAGCAGATTTCTT
GCTCTTAAAAGTTATGTTTCACTGAGTTCTGGTTTTGTGTAGCTATATTTATATAGCTAGATATTCCTCACAGT
GAACATGAATTGTAATAATTGGTTATTTCCTTAAGTCTTTAGATTATAATAATTTCAGATTATTGCACGTCTGTG
ATTTGAGAGGTGAGTTATTTAAGAGGCCAGTTTTCAGGACATGGGAATTTGAATTGTAAACCTGTTATCTCTGTG
AAACTTTTAACATGATAAAATATAACCTTTCTTTGTGCTTAAAAAAAAAAA
```

FIGURE 342

MASETHNVKKRNFCNKIEDHFIDLPRKKISNFTNKNMKEVKKSPKQLAAYINRTVGQTVKSPDKLRKVIYRRKKV
HHPFPNPCYRKKQSPGSGGCDMANKENELACAGHLPEKLHHDSRTYLVNSSDSGSSQTESPSSKYSGFFSEVSQD
HETMAQVLFSRNMRLNVALTFWRKRSISELVAYLLRIEDLGVVVDCLPVLTNCLQEEKQYISLGCCVDLLPLVKS
LLKSKFEEYVIVGLNWLQAVIKRWWSELSSKTEIINDGNIQILKQQLSGLWEQENHLTLVPGYTGNIAKDVDAYL
LQLH

FIGURE 343

```
GGGGGCCCTCCGCAGGTTCAGTCCTCGCGTCGGCCGCCCCGCGCTCAGTCGCGCGCACCTTCTCTCGCGGCCGGG
GGACCGCAGCGCGGGGCTAGCCCGGAGACCCGGCCACCGGCCTGGGGCGCCTTCACGCCGTCTCGGAGCGGATAA
TGCGGTGAGCAGGCACCACGCCGGCAGACTCGGCTGGATCTGCGCACAGCGGCAGGGATTGCGTGCGCCCGCGGG
AGGCCCGGGGCAGCGGCTGGGATCCTCAGCGGCGGCCGGTTTGTCCTGGTTGTGGTCAAGACTGGATGATGTAAC
TGGCTCTCTAGGAAGCCTCACTTGGCCGTAACCTCAGGAAGGTTCTCTTTGACCCCATCTCATTTCGAAGCCACT
TCTGAAGCCACTTGAGAAAATGATGTGACAGTTCCTATCAAAAAGGATTCAGAAACATATACCATCTGTGAAGA
AAGTGGCCCTTTCTCCCGCTTGCAAAATAGACATTCTCAAATTCCAAAATGCCAGCCAAGACCCCAATTTACCTG
AAAGCAGCCAATAACAAGAAAGGAAAGAAATTTAAACTGAGGGACATTCTGTCTCCTGATATGATCAGTCCCCCG
CTTGGAGACTTTCGCCACACCATCCACATTGGCAAAGAGGGCCAGCACGATGTCTTTGGAGATATTTCCTTTCTT
CAAGGGAACTACGAGCTTTTACCTGGAAACCAGGAGAAAGCACACCTGGGCCAGTTCCCTGGGCATAATGAGTTC
TTCCGGGCCAACAGCACCTCGGACTCTGTGTTCACAGAAACGCCCTCCCCGGTGCTCAAAAATGCCATCTCCCTC
CCGACCATTGGAGGATCCCAAGCTCTCATGTTGCCCTTATTGTCACCAGTGACATTTAATTCCAAACAGGAGTCC
TTCGGGCCAGCAAAGCTGCCCAGGCTTAGCTGCGAGCCCGTCATGGAGGAAAAAGCTCAGGAGAAAAGCAGTCTG
TTGGAGAATGGGACAGTCCACCAGGGAGACACCTCGTGGGGCTCCAGCGGTTCTGCATCTCAGTCCAGCCAAGGC
AGAGACAGCCACTCCTCCAGCCTGTCCAACAGTACCCCGACTGGCCAGCCGAGGACATGTTTGACCATCCCACC
CCATGCGAGCTCATCAAGGGAAAGACTAAGTCAGAGGAGTCCCTCTCTGACCTTACAGGTTCCCTCCTCTCCCTG
CAGCTTGATCTTGGGCCCTCACTTTTGGATGAGGTGCTGAATGTAATGGATAAAAATAAGTAACAAGATGCCAAC
TTTTTCCTTTGGGGTAAAAGGTACAAAAACAAACTAACCACAGTTGAAGAGAAGGGCTTCCGGAGCTGTATTTG
CAGTTTTGTGTTGGGTTTTCTAAAATAATATTCTTACAAAGTATTTTTTACCTGTTATGCCCTGTTTGCAAAAA
CAATTTAGAAAAAAACAACAAAGCAAAACCTATCTTGGCAAAAAAAGGAAGTGAGTCAGAGCCCATTTCAGGAG
GCATTGGTGATGTTCGGCTCACATATTGTTTGCAGACACACAAGAAATCTGGCTTGGCCAGGATTGGCACTAGCT
ATGAAGGGCTGAGCGAGTCACATTAAGGAACTTCACGGAACTTTATAGCACTCCGACATTTCTGAGCAAGAGGA
AGTCAAAATTTATTTAACACCTAAGCCTTTTGTAGACTCTTTTCTATATATTGCTTAGGCTCACCATAGTGAAT
TCTCCAGTGTTAAAACTTTTCTGTTTTCACATTTGAACTTTATGGGTTTTGGGGATTTTCTTGTAGTTCTTATAT
ATCCCTATATATTATATCTATATTGCAAAATTTTGACTGTCAGCTACATGTTGGTAAGACACAGGCAAAGTATTA
CTGTAACTAAGTTATTTTTAAAGTTAAAATATATTTTTACGTGCCTTTGGCTTTTTATTGCAGAGTCTACATTTT
ATAGATTCTACATCAGATGTTGTCACTTATTTCCATTGGGATTCCATTGTAAGCTGTGTATGTGCGTGTTTGGAA
AAGTGTATTCATACTTAGTTTTTTTTCTTCATCTGTTATCATACTTTTAACAGCAACCAATAACGGATTGTAAA
GTGTAAAGGCACAGGTTACTCATGATGCTTCTGCAGAGACTGTGGGCTACACCACATATGTTATTTGGAAATATA
GGTATTTTAGTACAGTACATACTTGCATTACATAGGTACTTCAAGCAACACAATAAAAAGTAAATGATAAAGTGA
ACTTGCTTGTTTATAGTAATAAACAAGACCATAAGAGAATAAGTATAGCTAGAGAAATTGCTTCTCTGAAATGTA
CATGAGCCCTTAAGGTAAGAGATGATTTCCATCTACTCTCATTTTGATTACTTCCTTATGGTTTGAGAGGCTAGA
AACTGAGCCTCTCTACTTTTGGAAAAATGAACATGTGAGGTCAGATTTTTTTTTTTTTAAGTCAGCACTGATG
CCACCCTCTCAGTGGTCATTTCTGAGCATCTTCCTGACTTGAACACCTTCTACAGCAAACTCTTGCAAGTCCAGT
TTCATCCCTGTAAGGCAAATGTCTTTCACGCAGAAAGTGCCATATAGACGAGATAAAGGCAGCTAAAACGAGGG
CAGTAGAGAGCACTTACCCGACCCCAAGGTGCCAGAGATGCCCTGAGGATGGTGGTTAAGGAAACAGGAGCAGGA
AATGTACACACAGATTCCTGTCCCTTTGCCAACTACTCCTTCCCCATCAAAGAAAAACATTGCACACAGTAACT
ACCAGCTCCTTCTCTCAAACTTGTATTTCTCCTGGAAATGTATCTCAGAAATGACCTCCTCTCCCAACCACTTCA
ACGATTCTTTCTTTGGGTTTGGGGTTCTTGCAGTTCTATCATCTAAAATAACCTTTGGACTGCAGGTAAAATGCA
ATTAGGACAACTAACCAAGTAGACGAAACAAGTTCCCCTAGGCAGGGGTGTCCAATATTTTAGCTTCCCTGGACC
GCATTGGAAGAATTTTCTTGGGCCACATGTAAAACACACTAACACTAACCATAGTTGATGAGCTTAAAAAAATAA
AAATAGAAAATTGC
```

FIGURE 344

MISPPLGDFRHTIHIGKEGQHDVFGDISFLQGNYELLPGNQEKAHLGQFPGHNEFFRANSTSDSVFTETPSPVLK
NAISLPTIGGSQALMLPLLSPVTFNSKQESFGPAKLPRLSCEPVMEEKAQEKSSLLENGTVHQGDTSWGSSGSAS
QSSQGRDSHSSSLSEQYPDWPAEDMFDHPTPCELIKGKTKSEESLSDLTGSLLSLQLDLGPSLLDEVLNVMDKNK

FIGURE 345

AGGAGAGAAACCCAAAGAAGGGGTGCCAGACAGCTCTGTGCAACCTCTTAGCCCATGAGTGGGATAGATACCACT
GCTGCTTTAAAAAAATGGGAGACCATAGACCCTCAGGAGAGAAGAATCCCTTCTACCCTGGACTCGCTCTCTTCT
CTGGAACTAACTTCTCCCCCATACCCTGATTGTCTTTGGAGAAAATGTTCTGGATTCTAGAATCTAAGGCAGAGC
CTTTTAAGCCATACTGTACACATAAATCACCTGGAACCTTGTTAAAATGCAGATCCTGACTCAGGAGGTCTGAGT
TAGAGCCCAGGATTTCATATTTCTAGCCAGCTCCATGATGAGCTGCTGGTCCGCAGATCACGCTTGCAGGTTTTG
ACCAGAGTCAGTGTTGGTTAGAGTAAGAGAATGAGGCAGACATCTGGGAAAAGTCCAGCTGGGGCAAGCATTTGA
AGTCTGCCTTCCTACCAGGTCAAAATCAAGGCAACGACCTTCCATAGATAACTATCAAAGCTTGAGGGGGTGCCT
TGAACCCAACTCCTAAATCCCCAAGACCTGCCCACCTCTTGTGTCTCCTGTCTCAGCAAACATTCCCACACTCTT
GCATATTGTTAAAGTAACCTCTGCTTACCAGGCTTCTGGTTTAATAAAAGATGGCTAGAGTGACTCCATCTTAAA
GCAAGTAGCTAGGCACTCAAAAGGAACCTACAGGCTTAATACTTGGGTCTGAAAATAGCCACAGTCTAAGCTGAC
CACCAATTATAATTGCAGAATATTTAAGGCCATACAAAACATCTCCCACTAAGCCTACAAAATGTCCAGGTGTCC
TAAAAGTTCAGCCCACTTAAAGGCAGCATTAATGAGCAGGTTTAGGTTGAAGGATTAATGGTCATCAATACCACT
GTTAAGAAGAAAATTCTTGGCCAAATTGAATTTAATGGAGTTTAACTGAGCAGACAATTCACAAATCTAGAAGCC
TCCTGAGCCAGAGTAGGTTCAGAGAGTCTTGAACACAGCCACGTGGTGGAAGAAGATTTATGGACAGGAAAAGGA
AAATGATGTACTGAAAATGAAAGTGAGGTACAGAAACAGCCAGACTGGTTATAGCTCAGCATTGGCCTTATTTGA
ACGAGATTTGAACAGTTGGCCACCTTTGATTGGCCGAAACTCAGTGATTGGCACAAGAGTAGGTTGCAGTCTGTT
TACACATCCTTTTAGGTTATAGTTCACCATGTACAGAGAAATTTAGGCCAAACTTAAAATATGTAAGGAGGCAG
CTTTAGGCTAAACTTGATTTAACAGCACCAATACCCCCTACCTTTAGTGAGCACATCTGCACATTCCAATTTTAA
TGACAGCTCCTTAGAATTTCTTATCAACGAAGACACTAACAAAGAATGGCGCATTCCTCCTTCTCCTTTCTGAGG
ATGCCCTACCCTGTAACAAAGTCGTTTCTAATAAATTTGCTTCTTTCACCATA

FIGURE 346

ERNPKKGCQTALCNLLAHEWDRYHCCFKKMGDHRPSGEKNPFYPGLALFSGTNFSPIP

FIGURE 347

```
TAGAGTATTTAGGATATTTACTGCAACATTGTTTATAATAGCAAAAAAGAAATACTAGAAAAAGCTTCACTGTAC
AGCAACAAATGGTTAAATATATAATGTATAATCTATACAATAGCATGCAGTAGGTCTCTTAACTCCACTTAACAC
ATTCACAAAACTCCCCAGGGCGCATCCCTCCCCATTAGCCACCTCCCATCATGTCATAGGTAGATATGCAAAATG
CTATATTGAAGGGCCAGGTAAATCTCAGTCAGGATGGCATTACGGCATGGAGAGACAAGTTATTATAGTACAGCA
CATGCTTGATTCCATGAGTCAAACTGCATGCTTCCAAGAGATAGTTGTGTTCGCTCCTGTGACTATTTCATGCCA
GAGTTGCTTGTTGACACTGTGATTTCAAT
```

FIGURE 348

```
GTTTTGCCTGCTAGCATCTCCCTGTAACTCTCCCAATCTTGAGGAGTGATCCCTGTCCCAGCCCCTGGAAAGGGG
CAGGAACGACAAACTCAAAGTCCAGGATGTTCACCATGACAAGAGCCATGGAAGAGGCTCTTTTTCAGCACTTCA
TGCACCAGAAGCTGGGGATCGCCTATGCCATACACAAGCCATTTCCCTTCTTTGAAGGCCTCCTAGACAACTCCA
TCATCACTAAGAGAATGTACATGGAATCTCTGGAAGCCTGTAGAAATTTGATCCCTGTATCCAGAGTGGTGCACA
ACATTCTCACCCAACTGGAGAGGACTTTTAACCTGTCTCTTCTGGTGACATTGTTCAGTCAAATTAACCTGCGTG
AATATCCCAATCTGGTGACGATTTACAGAAGCTTCAAACGTGTTGGTGCTTCCTATGAACGGCAGAGCAGAGACA
CACCAATCCTACTTGAAGCCCCAACTGGCCTAGCAGAAGGAAGCTCCCTCCATACCCCACTGGCGCTGCCCCCAC
CACAACCCCCTCAACCAAGCTGTTCACCCTGTGCGCCAAGAGTCAGTGAGCCTGGAACATCCTCCCAGCAAAGCG
ATGAGATCCTGAGTGAGTCGCCCAGCCCATCTGACCCTGTCCTGCCTCTCCCTGCACTCATCCAGGAAGGAAGAA
GCACTTCAGTGACCAATGACAAGTTAACATCCAAAATGAATGCGGAAGAAGACTCAGAAGAGATGCCCAGCCTCC
TCACTAGCACTGTGCAAGTGGCCAGTGACAACCTGATCCCCCAAATAAGAGATAAAGAAGACCCTCAAGAGATGC
CCCACTCTCCCTTGGGCTCTATGCCAGAGATAAGAGATAATTCTCCAGAACCAAATGACCCAGAAGAGCCCCAGG
AGGTGTCCAGCACACCTTCAGACAAGAAAGGAAAGAAAAGAAAAAGATGTATCTGGTCAACTCCAAAAAGGAGAC
ATAAGAAAAAAAGCCTCCCAAGAGGGACAGCCTCATCTAGACACGGAATCCAAAAGAAGCTCAAAAGGGTGGATC
AGGTTCCTCAAAAGAAAGATGACTCAACTTGTAACTCCACGGTAGAGACAAGGGCCCAAAAGGCGAGAACTGAAT
GTGCCCGAAAGTCGAGATCAGAGGAGATCATTGATGGCACTTCAGAAATGAATGAAGGAAAGAGGTCCCAGAAGA
CGCCTAGTACACCACGAAGGGTCACACAAGGGGCAGCCTCACCTGGGCATGGCATCCAAGAGAAGCTCCAAGTGG
TGGATAAGGTGACTCAAAGGAAAGACGACTCAACCTGGAACTCAGAGGTCATGATGAGGGTCCAAAAGGCAAGAA
CTAAATGTGCCCGAAAGTCCAGATCGAAAGAAAAGAAAAAGGAGAAAGATATCTGTTCAAGCTCAAAAAGGAGAT
TTCAGAAAAATATTCACCGAAGAGGAAAACCCAAAAGTGACACTGTGGATTTTCACTGTTCTAAGCTCCCCGTGA
CCTGTGGTGAGGCGAAAGGGATTTTATATAAGAAGAAAATGAAACACGGATCCTCAGTGAAGTGCATTCGGAATG
AGGATGGAACTTGGTTAACACCAAATGAATTTGAAGTCGAAGGAAAAGGAAGGAACGCAAAGAACTGGAAACGGA
ATATACGTTGTGAAGGAATGACCCTAGGAGAGCTGCTGAAGCGGAAAAACTCGGATGAATGCGAGGTGTGCTGTC
AAGGGGGACAACTTCTCTGCTGCGGTACTTGTCCACGAGTCTTCCATGAGGACTGTCACATCCCCCCTGTGGAAG
CCAAGAGGATGCTGTGGAGTTGCACCTTCTGCAGGATGAAGAGGTCTTCAGGAAGCCAACAGTGCCATCATGTAT
CTAAGACCCTGGAGAGGCAGATGCAGCCTCAGGACCAGCTGAAATGTGAGTTCCTCCTCTTGAAGGCCTACTGTC
ATCCACAAAGCTCCTTTTTTACGGGCATCCCATTTAATATTCGAGATTACGGTGAGCCCTTTCAGGAAGCAATGT
GGTTGGACCTGGTTAAGGAAAGGCTGATTACGGAAATGTACACGGTGGCATGGTTTGTGCGAGACATGCGCCTGA
TGTTTCGCAACCATAAAACATTTTACAAGGCTTCTGACTTTGGCCAGGTAGGACTTGACTTAGAGGCAGAATTTG
AAAAAGATCTCAAAGACGTGCTCGGTTTTCATGAAGCCAATGACGGCGGTTTCTGGACTCTTCCTTGACCCTGTT
CTGTAAAGACTGAAGCATCCCCACCTCAGGATTCAGCTGATGGGACCCTGGCTTGGACTGTTGATTGCCAGTGAG
TCTGGGATGTAATTGGCTGCCCTCAGGACCCAAACCCAGACACTTCATAGGATTATCACACCCTCCATCTTTATT
CTTTCTTTTTACCTTTAAAAGTCTATATCTA
```

FIGURE 349

MFTMTRAMEEALFQHFMHQKLGIAYAIHKPFPFFEGLLDNSIITKRMYMESLEACRNLIPVSRVVHNILTQLERT
FNLSLLVTLFSQINLREYPNLVTIYRSFKRVGASYERQSRDTPILLEAPTGLAEGSSLHTPLALPPPQPPQPSCS
PCAPRVSEPGTSSQQSDEILSESPSPSDPVLPLPALIQEGRSTSVTNDKLTSKMNAEEDSEEMPSLLTSTVQVAS
DNLIPQIRDKEDPQEMPHSPLGSMPEIRDNSPEPNDPEEPQEVSSTPSDKKGKKRKRCIWSTPKRRHKKKSLPRG
TASSRHGIQKKLKRVDQVPQKKDDSTCNSTVETRAQKARTECARKSRSEEIIDGTSEMNEGKRSQKTPSTPRRVT
QGAASPGHGIQEKLQVVDKVTQRKDDSTWNSEVMMRVQKARTKCARKSRSKEKKKEKDICSSSKRRFQKNIHRRG
KPKSDTVDFHCSKLPVTCGEAKGILYKKKMKHGSSVKCIRNEDGTWLTPNEFEVEGKGRNAKNWKRNIRCEGMTL
GELLKRKNSDECEVCCQGGQLLCCGTCPRVFHEDCHIPPVEAKRMLWSCTFCRMKRSSGSQQCHHVSKTLERQMQ
PQDQLKCEFLLLKAYCHPQSSFFTGIPFNIRDYGEPFQEAMWLDLVKERLITEMYTVAWFVRDMRLMFRNHKTFY
KASDFGQVGLDLEAEFEKDLKDVLGFHEANDGGFWTLP

FIGURE 350

```
TCGGAGCTGAACTTCCTAAAAGACAAAGTGTTTATCTTTCAAGATTCATTCTCCCTGAATCTTACCAACAAAACA
CTCCTGAGGAGAAAGAAAGAGAGGGAGGGAGAGAAAAAGAGAGAGAGAGAAACAAAAAACCAAAGAGAGAGAAAA
AATGAATTCATCTAAATCATCTGAAACACAATGCACAGAGAGAGGATGCTTCTCTTCCCAAATGTTCTTATGGAC
TGTTGCTGGGATCCCCATCCTATTTCTCAGTGCCTGTTTCATCACCAGATGTGTTGTGACATTTCGCATCTTTCA
AACCTGTGATGAGAAAAAGTTTCAGCTACCTGAGAATTTCACAGAGCTCTCCTGCTACAATTATGGATCAGGTTC
AGTCAAGAATTGTTGTCCATTGAACTGGGAATATTTTCAATCCAGCTGCTACTTCTTTTCTACTGACACCATTTC
CTGGGCGTTAAGTTTAAAGAACTGCTCAGCCATGGGGGCTCACCTGGTGGTTATCAACTCACAGGAGGAGCAGGA
ATTCCTTTCCTACAAGAAACCTAAAATGAGAGAGTTTTTTATTGGACTGTCAGACCAGGTTGTCGAGGGTCAGTG
GCAATGGGTGGACGGCACACCTTTGACAAAGTCTCTGAGCTTCTGGGATGTAGGGGAGCCCAACAACATAGCTAC
CCTGGAGGACTGTGCCACCATGAGAGACTCTTCAAACCCAAGGCAAAATTGGAATGATGTAACCTGTTTCCTCAA
TTATTTTCGGATTTGTGAAATGGTAGGAATAAATCCTTTGAACAAAGGAAAATCTCTTTAAGAACAGAAGGCACA
ACTCAAATGTGTAAAGAAGGAAGAGCAAGAACATGGCCACACCCACCGCCCCACACGAGAAATTTGTGCGCTGAA
CTTCAAAGGACTTCATAAGTATTTGTTACTCTGATATAAATAAAAATAAGTAGTTTTAAATGTTATAATTCATGT
TACTGGCTGAAGTGCATTTCTCTCTACGTTAGTCTCAGGTCCTCTTCCCAGAATTTACAAAGCAATTCATACCT
TTTGCTACATTTGCCTCATTTTTAGTGTTCGTATGAAAGTACAGGGACACGGAGCCAAGACAGAGTCTAGCAAA
GAAGGGGATTTTGGAAGGTGCCTTCCAAAAATCTCCTGAATCCGGGCTCTGTAGCAGGTCCTCTTCTTTCTAGCT
TCTGACAAGTCTGTCTTCTCTTCTTGGTTTCATACCGTTCTTATCTCCTGCCCAAGCATATATCGTCTCTTTACT
CCCCTGTATAATGAGTAAGAAGCTTCTTCAAGTCATGAAACTTATTCCTGCTCAGAATACCGGTGTGGCCTTTCT
GGCTACAGGCCTCCACTGCACCTTCTTAGGGAAGGGCATGCCAGCCATCAGCTCCAAACAGGCTGTAACCAAGTC
CACCCATCCCTGGGGCTTCCTTTGCTCTGCCTTATTTTCAATTGACTGAATGGATCTCACCAGATTTGTATCTA
TTGCTCAGCTAGGACCCGAGTCCAATAGTCAATTTATTCTAAGCGAACATTCATCTCCACACTTTCCTGTCTCAA
GCCCATCCATTATTTCTTAACTTTTATTTTAGCTTTCGGGGGTACATGTTAAAGGCTTTTTATATAGGTAAACTC
ATGTCGTGGAGGTTTGTTGTACAGATTATTTCATCACCCAGGTATTAAGCCCAGTGCCTAATATTGTTTTTTTCG
GCTCCTCTCCCTCCTCCTACCTTCCGCCCTCAAGTAGACTCCAGTGTCTGTTATTCCCTTCTTTGTGTTTATGAA
TTCTCATCATTTAGCTCCCACTTATAAGTGAGGACATGCAGTATTTGGTTTTCTGTTCCCATGTTTGCTAAGGAT
AATGGTTTCCAGTTCTACCGATGTTCCCACAAAAGACATAATTTTCTTTTTTAAGGCTGCTTAGTATTCCATGGT
ATCTATGTATCACATTTTCTCTATCCAATCTATTGTTGACTCACATTTAGATTGATTCCATGTTTTGCTATTGT
GAATAGTGCTGCAATGAACATTCGTGTGCATGTGTCTTTATGGTAGAAAGATTTATATTTCTCTGAGTATGTATC
CAGTAATAGCCCATTCATTTATTGCATAAAATTCTACCAATAC
```

FIGURE 351

MNSSKSSETQCTERGCFSSQMFLWTVAGIPILFLSACFITRCVVTFRIFQTCDEKKFQLPENFTELSCYNYGSGS
VKNCCPLNWEYFQSSCYFFSTDTISWALSLKNCSAMGAHLVVINSQEEQEFLSYKKPKMREFFIGLSDQVVEGQW
QWVDGTPLTKSLSFWDVGEPNNIATLEDCATMRDSSNPRQNWNDVTCFLNYFRICEMVGINPLNKGKSL

FIGURE 352

TTTCATTTCCTCACTGACTATAAAAGAATAGAGAAGGAAGGGCTTCAGTGACCGGCTGCCTGGCTGACTTACAGC
AGTCAGACTCTGACAGGATCATGGCTATGATGGAGGTCCAGGGGGGACCCAGCCTGGGACAGACCTGCGTGCTGA
TCGTGATCTTCACAGTGCTCCTGCAGTCTCTCTGTGTGGCTGTAACTTACGTGTACTTTACCAACGAGCTGAAGC
AGATGCAGGACAAGTACTCCAAAAGTGGCATTGCTTGTTTCTTAAAAGAAGATGACAGTTATTGGGACCCCAATG
ACGAAGAGAGTATGAACAGCCCCTGCTGGCAAGTCAAGTGGCAACTCCGTCAGCTCGTTAGAAAGATGATTTTGA
GAACCTCTGAGGAAACCATTTCTACAGTTCAAGAAAAGCAACAAAATATTTCTCCCCTAGTGAGAGAAAGAGGTC
CTCAGAGAGTAGCAGCTCACATAACTGGGACCAGAGGAAGAAGCAACACATTGTCTTCTCCAAACTCCAAGAATG
AAAAGGCTCTGGGCCGCAAAATAAACTCCTGGGAATCATCAAGGAGTGGGCATTCATTCCTGAGCAACTTGCACT
TGAGGAATGGTGAACTGGTCATCCATGAAAAAGGGTTTTACTACATCTATTCCCAAACATACTTTCGATTTCAGG
AGGAAATAAAAGAAAACACAAAGAACGACAAACAAATGGTCCAATATATTTACAAATACACAAGTTATCCTGACC
CTATATTGTTGATGAAAAGTGCTAGAAATAGTTGTTGGTCTAAAGATGCAGAATATGGACTCTATTCCATCTATC
AAGGGGGAATATTTGAGCTTAAGGAAAATGACAGAATTTTTGTTTCTGTAACAAATGAGCACTTGATAGACATGG
ACCATGAAGCCAGTTTTTTCGGGGCCTTTTTAGTTGGCTAACTGACCTGGAAAGAAAAAGCAATAACCTCAAAGT
GACTATTCAGTTTTCAGGATGATACACTATGAAGATGTTTCAAAAAATCTGACCAAAACAAACAAACAGAAAACA
GAAAACAAAAAAACCTCTATGCAATCTGAGTAGAGCAGCCACAACCAAAAAATTCTACAACACACACTGTTCTGA
AAGTGACTCACTTATCCCAAGAGAATGAAATTGCTGAAAGATCTTTCAGGACTCTACCTCATATCAGTTTGCTAG
CAGAAATCTAGAAGACTGTCAGCTTCCAAACATTAATGCAATGGTTAACATCTTCTGTCTTTATAATCTACTCCT
TGTAAAGACTGTAGAAGAAAGAGCAACAATCCATCTCTCAAGTAGTGTATCACAGTAGTAGCCTCCAGGTTTCCT
TAAGGGACAACATCCTTAAGTCAAAAGAGAGAAGAGGCACCACTAAAAGATCGCAGTTTGCCTGGTGCAGTGGCT
CACACCTGTAATCCCAACATTTTGGGAACCCAAGGTGGGTAGATCACGAGATCAAGAGATCAAGACCATAGTGAC
CAACATAGTGAAACCCCATCTCTACTGAAAGTACAAAAATTAGCTGGGTGTGTTGGCACATGCCTGTAGTCCCAG
CTACTTGAGAGGCTGAGGCAAGAGAATTGTTTGAACCCGGGAGGCAGAGGTTGCAGTGTGGTGAGATCATGCCAC
TACACTCCAGCCTGGCGACAGAGCGAGACTTGGTTTCAAAAAAAAAAAAAAAAAAAAACTTCAGTAAGTACGTGTT
ATTTTTTTCAATAAAATTCTATTACAGTATGTCAAAAAAAAAAAAAAAAAA

FIGURE 353

MAMMEVQGGPSLGQTCVLIVIFTVLLQSLCVAVTYVYFTNELKQMQDKYSKSGIACFLKEDDSYWDPNDEESMNS
PCWQVKWQLRQLVRKMILRTSEETISTVQEKQQNISPLVRERGPQRVAAHITGTRGRSNTLSSPNSKNEKALGRK
INSWESSRSGHSFLSNLHLRNGELVIHEKGFYYIYSQTYFRFQEEIKENTKNDKQMVQYIYKYTSYPDPILLMKS
ARNSCWSKDAEYGLYSIYQGGIFELKENDRIFVSVTNEHLIDMDHEASFFGAFLVG

FIGURE 354

```
CGTGCTGTAGCTGGTTCTTACGTCCAACCTGGGGGCAGTCTGCCCAGATCGCCTGCCTGGCCTCGCCTCTGCCCA
TCAGACACTTGGTGCTGGAATCTCCGAGGCTGGGAGGGACTGGGAGCGCCCCAGTTCTGTGTCCTCCCCACACAG
CCCCTTTTATGTAACTTGACTAAGATCAAGCAGTTAGTAAATGGTAGAAAGAATATTTGAATCTACCTAGTGAGT
CTCTAGTGCATGCTTTTGTCCGGTATCCTGGAAAGCCTCCCACAAAAAGCTAATCTTTGCCCCATTCAAAACATG
CACCCTGAAGAAGCTGTTTGTACAGGATTGGGTTTATTCTGTTATTAAGACAAAGGCATCATGGCCTTTGGGTGA
GAGGCCCGTATGTGTTTGGGATTTGGCAATCAGCATTCCATCTCTGTCATCACCATTATTGAGAAAATAGATGGA
TTGGTTCCCTCTCTGCAGTCCTGTGGAGCAGTTGGACTGCTCTCTGCTCTCAGGATGATACTGTGAGAACAAT
TTAAATATGCTAAGCACATGTCAGGAAACAGTTTTGTGGTCTTTGGACACTCGCTGTAGCCATTCCGTTCCATTT
CAGGTGATTTTATTCATTTCATTTGTAGAATAAAATAAATCCATTTNNNNNNNNNNNNNNNNNNNNNNNNNNNNN
NNNNNNNNNNNNTATACACCACTAAAGCCTCCCATTAAACCCATAGAAGACTTAAAGAGCTAAAAGAGGCTATTN
NNNNNNNNNNNNNNNNNNNNNNNNNNNNNNNNNNNNNNNNNNNNNNNNATTATTAGGCACGGCATCTTGTTTTACACA
ACGTGTTTGATCTTCACTTCTTCTTAATATTTGGTGTTTGATCTTCTCACAAGTGGTTTTGCTTGC
```

FIGURE 355

RAVAGSYVQPGGSLPRSPAWPRLCPSDTWCWNLRGWEGLGAPQFCVLPTQPLLCNLTKIKQLVNGRKNI

FIGURE 356

```
CCGTCCCCGGCGGCCCCATGCCCCGATGCCCCGCGGGGGCCATGGACGAGGGGCCCGTGGACCTGCGCACCCGGC
CCAAGGCCGCCGGACTCCCGGGCGCCGCGCTGCCGCTCCGCAAGCGCCCGCTGCGCGCGCCCTCCCCGGAGCCCG
CCGCTCCCCGCGGCGCTGCGGGCCTTGTCGTCCCCCTGGACCCTCTGCGCGGCGGCTGCGACCTGCCGGCGGTCC
CCGGGCCCCCCCACGGCCTGGCCCGGCCGGAGGCGCTTTACTACCCCGGAGCCTTACTGCCTTTGTACCCCACTC
GGGCCATGGGCTCCCCGTTTCCTCTGGTGAACCTGCCTACACCCCTATACCCCATGATGTGCCCCATGGAACACC
CCCTTTCTGCTGACATCGCCATGGCCACCCGTGCAGATGAGGACGGAGACACGCCTCTCCATATTGCTGTGGTGC
AGGGTAACCTGCCAGCTGTGCACCGGCTGGTCAACCTCTTCCAGCAGGGGGGCCGGGAGCTCGACATCTACAACA
ACCTACGGCAGACACCGCTCCACCTGGCTGTGATCACCACATTACCGTCTGTGGTCCGGCTCCTGGTGACAGCTG
GTGCCAGCCCCATGGCGCTGGACCGCCATGGCCAGACGGCCGCTCACCTGGCGTGCGAGCACCGCAGCCCGACCT
GCCTGCGAGCCCTGCTGGACAGCGCAGCTCCGGGCACGTTGGACCTGGAGGCCCGCAATTATGACGGGCTCACCG
CCCTGCACGTGGCAGTGAACACCGAGTGCCAAGAAACCGTGCAGCTCTTGCTAGAGCGCGGTGCCGACATCGACG
CAGTGGACATTAAGAGCGGCCGCTCCCCGCTCATCCACGCCGTGGAAAACAACAGCCTTAGCATGGTGCAGCTGC
TGCTGCAGCACGGCGCCAACGTGAACGCGCAAATGTACTCCGGCAGCTCCGCCCTGCACTCAGCGTCCGGCCGCG
GGCTCCTCCCGCTGGTGCGCACGCTGGTCCGCAGCGGCGCTGACAGCAGCCTCAAGAACTGCCACAACGACACGC
CGCTCATGGTGGCGCGCAGCCGCAGGGTCATCGACATCCTGAGGGGGAAGGCCACCCGGCCTGCTTCCACCTCCC
AGCCAGACCCCTCCCCTGACCGGAGCGCCAACACCTCCCCGAGAGCAGCAGCCGCCTCAGCTCCAATGGTCTTC
TCTCCGCATCACCATCCTCCTCACCCTCCCAGTCTCCCCCAGGGACCCCCCTGGATTCCCCATGGCTCCTCCCA
ATTTCTTCCTTCCTTCCCCATCTCCACCCGCCTTCCTGCCCTTTGCTGGGGTCCTCCGAGGCCCTGGCCGGCCGG
TGCCCCCCTCCCCAGCTCCAGGAGGCAGCTGAGGGGGATGGGGGGGCAGATCTTGGACTCATGAGGAGGGCCCC
CCTGCCCAGAGGGGTCAACCCTTCTGGAAACTGTGAAGATCTGACTTCGCCCCCCCCCCCCCATCTTCGGGAC
CAGGATTGCACAGAAGCAGATGCACCTACCCATACACCCCTCTTCTGAGCACAGATGTTCCCCCATCTCGCTC
CCTCCCAGGACTCTGACCCCAGCATTCTCAGGCACCAGTCCCTGTCCGGAATGCCACCCACATCTTCCATTTCCA
TGTCCCCTCCCAGAGCTGGTGGACCCAGGGAACAGCCACTCCCCTCCACTCTCTACCAGATAACTGAGGAGGGGA
GAGGTGGGCCGTAACGGGCACGGATCACGATGTAAATTATTAAGCATTTTGGTTGGATTTCTTTTGTAATAAACT
ATTTTTGTACCAT
```

FIGURE 357

MDEGPVDLRTRPKAAGLPGAALPLRKRPLRAPSPEPAAPRGAAGLVVPLDPLRGGCDLPAVPGPPHGLARPEALY
YPGALLPLYPTRAMGSPFPLVNLPTPLYPMMCPMEHPLSADIAMATRADEDGDTPLHIAVVQGNLPAVHRLVNLF
QQGGRELDIYNNLRQTPLHLAVITTLPSVVRLLVTAGASPMALDRHGQTAAHLACEHRSPTCLRALLDSAAPGTL
DLEARNYDGLTALHVAVNTECQETVQLLLERGADIDAVDIKSGRSPLIHAVENNSLSMVQLLLQHGANVNAQMYS
GSSALHSASGRGLLPLVRTLVRSGADSSLKNCHNDTPLMVARSRRVIDILRGKATRPASTSQPDPSPDRSANTSP
ESSSRLSSNGLLSASPSSSPSQSPPRDPPGFPMAPPNFFLPSPSPPAFLPFAGVLRGPGRPVPPSPAPGGS

FIGURE 358

ATTTCTCTGAAGATTCTACATCTCTACACAAGATATTCATTCTTTTGGTCACCTAGGGATCTTCTAAGTGTGATA
TTACTTTCAGAGAATTCAGACAAGTGAGAAACAATAATGTAGGAGTCAGCAAAGCAGAATTCAGAGACTTCAGCC
AATCACTGCTGCTCTGAGAGGATCCAGTTAGAGACTCAGTATCAGCGGTCAGAACTTATCTCACTCCTGTGAACT
TCAGGCTGGACTTAAAGCTGCCAAGTTTCCCCTGCAGGGAAGGAAACACTGCCTCCCTTCAGCAGGTAGCTCAT
TAGAAAGCCAAACAGGCAAACGATCCTGGCCTCTCCCGCCAGCTGACCGCTCTTCAGCATCCATGCGGTTGTAGT
CGTGACTTTCTCAGTCACGATCAAGGGTGATTTTTTCTTAAATATCAAGCTGTTCTTTGAACAGGGAATGAACAT
GAGTTTTTGTAACGTGACTGAAGTTGAGTTTAAGTAGGAAGCGCAGGAAGTTCCCAAGTGCCAGGTGTGTGTAGC
TCAGAGTTCCTTTTACAGTGAGGTGTCTCTCACTGGGGGAGCTTCCAGGATCCTGAGCAGACTGGACACAATCAT
CTCTCCCTTCCTCTATGTCAAGCACTGTTACAAAAGACTGTGAGCAAATTTCCATCTAAATATTAATAATTCTGA
AGAAGAGGCAAAACTGTTGAATGCAAGCGATACCTATTGTTGAAGAAACCCACAAATTTCTGATTCTAAGATCAG
GGGATACAACAAAATCTACAAGTCATTTCAAATAGCACACAGGAATCAAACTTTGGTAAATCATTTCTGAGGCAC
AATTAAATATATTGTAGCACTATGTTAATTAATTATATTAAATGTCGATTCATCTTGAATGTATTCTCAATTGCC
TACCAAAAATTGGTATGATTATCATTTCTGGGTCTACTGATTTTTCATCATGGCAACAGAAATTGTCATTAAATA
GAATTAAGATACAACTATATATCTTATTATTTAAAAACATTCATAGACATATTCATAAAGTTTGAATTTAAAGTT
TTATTTTTGCAATTCAGTTGTATAGAAATGTTACATAAATTCCTAAATGCTCAATTCAGGTGGCATGATTTTTAG
AATATTATCTTCTTCAAGATGAATACTTAGGTCTACTTCAGCTCTGATATTCTATTTTTACTTTCTTACTTGAAG
TGAGAAAAGAGAATGGTGAATTGTATTATAGCGGTAATACATTATTTTTATTTTAGCTTAGATTTACATTTATCA
GTAAAACGTGTCAGTGGGCTGGGTGCAGTGGCTCATCCTCTTATCCCACCCAGATTTCTATCTGGTTGGTTAGGG
TAGTCCATGCCTCAAGGAAGGCGGTGCAGCTTAATTTAACATATTGTTCAGTAAAGAATCCCATTGTGTATCATA
AGAATCCCTTATCCTTTTCGGGCCCTCCACCATACCAGACTGAAAAGTATTCCATTGTCCAGAAGTAGCTG

FIGURE 359

ISLKILHLYTRYSFFWSPRDLLSVILLSENSDK

FIGURE 360

CTCCTCTGCCCAATGTCTCCCAATCTCTTTCCTTTCTCTCTTCAGTTCCTCCAGGTAATTCTTACTCAAACTTGT
ACCAACTTGTTTTTGACTGACAGTGAACAGTGAGAGAGTTTTCTTCATTTTGAGGAACCCTAAACACCTATCTTT
CCCAAGGCAACCTGTCTGGACTGAGCATTTCTCTGACTTGACATAACTTCCCATCCAGCCAGGAGTCTGCACTCT
TCAGTCTTTGCAGGCAGTAGCAGAATCCCATGGTAGCCAGGTGGGTGAAGGGGAGCGAGGACGTTCTACCTGCCT
TGAAGAAGACACCTGACCTGCGGAGTGAGTGACCAGTGTTCCAGAGCCTGGCAATGGATGCCATTCACATCGGC
ATGTCCAGCACCCCCTGGTGAAGCACACTGCTGGGGCTGGGCTCAAGGCCAACAGACCCCGCGTCATGTCCAAG
AGTGGGCACAGCAACGTGAGAATTGACAAAGTGGATGGCATATACCTACTCTACCTGCAAGACCTGTGGACCACA
GTTATCGACATGAAGTGGAGATACAAACTCACCCTGTTCGCTGCCACTTTTGTGATGACCTGGTTCCTTTTTGGA
GTCATCTACTATGCCATCGCGTTTATTCATGGGGACTTAGAACCCGATGAGCCCATTTCAAATCATACCCCCTGC
ATCATGAAAGTGGACTCTCTCACTGGGGCGTTTCTCTTTTCCCTGGAATCCCAGACAACCATTGGCTATGGAGTC
CGTTCCATCACAGAGGAATGTCCTCATGCCATCTTCCTGTTGGTTGCTCAGTTGGTCATCACGACCTTGATTGAG
ATCTTCATCACCGGAACCTTCCTGGCCAAAATCGCCAGACCCAAAAAGCGGGCTGAGACCATCAAGTTCAGCCAC
TGTGCAGTCATCACCAAGCAGAATGGGAAGCTGTGCTTGGTGATTCAGGTAGCCAATATGAGGAAGAGCCTCTTG
ATTCAGTGCCAGCTCTCTGGCAAGCTCCTGCAGACCCACGTCACCAAGGAGGGGAGCGGATTCTCCTCAACCAA
GCCACTGTCAAATTCCACGTGGACTCCTCCTCTGAGGGCCCCTTCCTCATTCTGCCCATGACATTCTACCATGTG
CTGGATGAGACGAGCCCCCTGAGAGACCTCACACCCCAAAACCTAAAGGAGAAGGAGTTTGAGCTTGTGGTCCTC
CTCAATGCCACTGTGGAATCCACCAGCGCTGTCTGCCAGAGCCGAACATCTTATATCCCAGAGGAAATCTACTGG
GGTTTTGAGTTTGTGCCTGTGGTATCTCTCTCCAAAAATGGAAAATATGTGGCTGATTTCAGTCAGTTTGAACAG
ATTCGGAAAAGCCCAGATTGCACATTTTACTGTGCAGATTCTGAGAAACAGCAACTCGAGGAGAAGTACAGGCAG
GAGGATCAGAGGGAAAGAGAACTGAGGACACTTTTATTACAACAGAGCAATGTCTGATCACAGG

FIGURE 361

```
MDAIHIGMSSTPLVKHTAGAGLKANRPRVMSKSGHSNVRIDKVDGIYLLYLQDLWTTVIDMKWRYKLTLFAATFV
MTWFLFGVIYYAIAFIHGDLEPDEPISNHTPCIMKVDSLTGAFLFSLESQTTIGYGVRSITEECPHAIFLLVAQL
VITTLIEIFITGTFLAKIARPKKRAETIKFSHCAVITKQNGKLCLVIQVANMRKSLLIQCQLSGKLLQTHVTKEG
ERILLNQATVKFHVDSSSEGPFLILPMTFYHVLDETSPLRDLTPQNLKEKEFELVVLLNATVESTSAVCQSRTSY
IPEEIYWGFEFVPVVSLSKNGKYVADFSQFEQIRKSPDCTFYCADSEKQQLEEKYRQEDQRERELRTLLLQQSNV
```

FIGURE 362

GCTCACTGAGCACCGTCCCAGCATCCGGACACCACAGCGGCCCTTCGCTCCACGCAGAAAACCACACTTCTCATA
CCTTCACTCAACACTTCCTTCCCCAAAGCCAGAAGATGCACAAGGAGGAACATGAGGTGGCTGTGCTGGGGGCAC
CCCCCAGCACCATCCTTCCAAGGTCCACCGTGATTAACATCCACAGCGAGACCTCCGTGCCCGACCATGTCGTCT
GGTCCCTGTTCAACACCCTCTTCTTGAACTGGTGCTGTCTGGGCTTCATAGCATTCGCCTACTCCGTAAAGTCTA
GGGACAGGAAGATGGTTGGCGACGTGACCGGGGCCCAGGCCTATGCCTCCACCGCCAAGTGCCTGAACATCTGGG
CCCTGATTCTGGGCATCCTCATGACCATTGGATTCATCCTGTTACTGGTATTCGGCTCTGTAACAGTCTACCATA
TTATGTTACAGATAATACAGGAAAAACGGGGTTACTAGTAGCCGCCCATAGCCTGCAACCTTTGCACTCCACTGT
GCAATGCTGGCCCTGCACGCTGGGGCTGTTGCCCCTGCCCCTTGGTCCTGCCCCTAGATACAGCAGTTTATACC
CACACACCTGTCTACAGTGTCATTCAATAAAGTGCACGTGCTTGTGA

FIGURE 363

MHKEEHEVAVLGAPPSTILPRSTVINIHSETSVPDHVVWSLFNTLFLNWCCLGFIAFAYSVKSRDRKMVGDVTGA
QAYASTAKCLNIWALILGILMTIGFILLLVFGSVTVYHIMLQIIQEKRGY

FIGURE 364

AAACTTTCTCTGATCTCCTCTCTCTGTGTCTGCTCCAAATGTAGACAGCAATTGTCTGGGTAGGACCAGCTTA
TAAAGAAGCATGGCTTTGTTAAGGAAGTCGTATTCAGAGCCTCAGCTTAAGGGTATAGTTACCAAGCTATACAGC
CGACAAGGCTACCACTTGCAGCTGCAGGCGGATGGAACCATTGATGGCACCAAAGATGAGGACAGCACTTACACT
CTGTTTAACCTCATCCCTGTGGGTCTGCGAGTGGTGGCTATCCAAGGAGTTCAAACCAAGCTGTACTTGGCAATG
AACAGTGAGGGATACTTGTACACCTCGGAACTTTTCACACCTGAGTGCAAATTCAAAGAATCAGTGTTTGAAAAT
TATTATGTGACATATTCATCAATGATATACCGTCAGCAGCAGTCAGGCCGAGGGTGGTATCTGGGTCTGAACAAA
GAAGGAGAGATCATGAAAGGCAACCATGTGAAGAAGAACAAGCCTGCAGCTCATTTTCTGCCTAAACCACTGAAA
GTGGCCATGTACAAGGAGCCATCACTGCACGATCTCACGGAGTTCTCCCGATCTGGAAGCGGGACCCCAACCAAG
AGCAGAAGTGTCTCTGGCGTGCTGAACGGAGGCAAATCCATGAGCCACAATGAATCAACGTAGCCAGTGAGGGCA
AAAGAAGGGCTCTGTAACAGAACCTTACCTCCAGGTGCTGTTGAATTCTTCTAGCAGTCCTTCACCCAAAAGTTC
AAATTTGTCAGTGACATTTACCAAACAAACAGGCAGAGTTCACTATTCTATCTGCCATTAGACCTTCTTATCATC
CATACTAAAGCCCCATTATTTAGATTGAGCTTGTGCATAAGAATGCCAAGCATTTAGTGAACTAAATCTGAGAG
AAGGACTGCCAAATTTTCTCATGATCTCACCTATACTTTGGGGATGATAATCCAAAAGTATTTCACAGCACTAAT
GCTGATCAAAATTTGCTCTCCCACCAAGAAAATGTAAAAGACCACAATTGTTCTTCAAAAACAAACAAAACAAAA
CAAAACAAAATTAACTGCTTAAATGTTTTGTCGGGCAAACAAAATTATGTGAATTGTGTTGTTTTCTTGGCTTG
ATGTTTTCTATCTACGCTTGATTCACATGTACTCTTTTCTTTGGCATAGTGCAACTTTATGATTTCTGAAATTCA
ATGGTTCTATTGACTTTTTGCGTCACTTAATCCAAATCAACCAAATTCAGGGTTGAATCTGAATTGGCTTCTCAG
GCTCAAGGTAACAGTGTTCTTGTGGTTTGACCAATTGTTTTTCTTTCTTTTTTTTTTTTAGATTTGTGGTATTC
TGGTCAAGTTATTGTGCTGTACTTTGTGCGTAGAAATTGAGTTGTATTGTCAACCCCAGTCAGTAAAGAGAACTT
CAAAAAATTATCCTCAAGTGTAGATTTCTCTTAATTCCATTTGTGTATCATGTTAAACTATTGTTGTGGCTTCTT
GTGTAAAGACAGGAACTGTGGAACTGTGATGTTGTCTTTGTGTTGTTAAAATAAGAAATGTCTTATCTGTATAT
GTATGAGTCTTCCTGTCATTGTATTTGGCACATGAATATTGTGTACAAGGAATTGTTAAGACTGGTTTTCCCTCA
ACAACATATATTATACTTGCTACTGGAAAAGTGTTTAAGACTTAGCTAGGTTTCCATTTAGATCTTCATATCTGT
TGCATGGAAGAAAGTTGGGTTCTTGGCATAGAGTTGCATGATATGTAAGATTTTGTGCATTCATAATTGTTAAAA
ATCTGTGTTCCAAAAGTGGACATAGCATGTACAGGCAGTTTTCTGTCCTGTGCACAAAAAGTTTAAAAAAGTTGT
TTAATATTTGTTGTTGTATACCCAAATACGCACCGAATAAACTCTTTATATTCATTCAAAGA

FIGURE 365

MALLRKSYSEPQLKGIVTKLYSRQGYHLQLQADGTIDGTKDEDSTYTLFNLIPVGLRVVAIQGVQTKLYLAMNSE
GYLYTSELFTPECKFKESVFENYYVTYSSMIYRQQQSGRGWYLGLNKEGEIMKGNHVKKNKPAAHFLPKPLKVAM
YKEPSLHDLTEFSRSGSGTPTKSRSVSGVLNGGKSMSHNEST

FIGURE 366

```
GTGGAATTCATGGCATCTACTTCGTATGACTATTGCAGAGTGCCCATGGAAGACGGGGATAAGCGCTGTAAGCTT
CTGCTGGGGATAGGAATTCTGGTGCTCCTGATCATCGTGATTCTGGGGGTGCCCTTGATTATCTTCACCATCAAG
GCCAACAGCGAGGCCTGCCGGGACGGCCTTCGGGCAGTGATGGAGTGTCGCAATGTCACCCATCTCCTGCAACAA
GAGCTGACCGAGGCCCAGAAGGGCTTTCAGGATGTGGAGGCCCAGGCCGCCACCTGCAACCACACTGTGATGGCC
CTAATGGCTTCCCTGGATGCAGAGAAGGCCCAAGGACAAAAGAAAGTGGAGGAGCTTGAGGGAGAGATCACTACA
TTAAACCATAAGCTTCAGGACGCGTCTGCAGAGGTGGAGCGACTGAGAAGAGAAAACCAGGTCTTAAGCGTGAGA
ATCGCGGACAAGAAGTACTACCCCAGCTCCCAGGACTCCAGCTCCGCTGCGGCGCCCCAGCTGCTGATTGTGCTG
CTGGGCCTCAGCGCTCTGCTGCAGTGAGATCCCAGGAAGCTGGCACATCTTGGAAGGTCCGTCCTGCTCGGCTTT
TCGCTTGAACATTCCCTTGATCTCATCAGTTCTGAGCGGGTCATGGGGCAACACGGTTAGCGGGGAGAGCACGGG
GTAGCCGGAGAAGGGCCTCTGGAGCAGGTCTGGAGGGGCCATGGGGCAGTCCTGGGTGTGGGGACACAGTCGGGT
TGACCCAGGGCTGTCTCCCTCCAGAGCCTCCCTCCGGACAATGAGTCCCCCCTCTTGTCTCCCACCCTGAGATTG
GGCATGGGGTGCGGTGTGGGGGGCATGTGCTGCCTGTTGTTATGGGTTTTTTTTGCGGGGGGGGTTGCTTTTTTC
TGGGGTCTTTGAGCTCCAAAAAATAAACACTTCCTTTGAGGGAGAGCAAAAAAAAAAAAAAAAAAAAAAAAAAAA
AAAAAAAA
```

FIGURE 367

MASTSYDYCRVPMEDGDKRCKLLLGIGILVLLIIVILGVPLIIFTIKANSEACRDGLRAVMECRNVTHLLQQELT
EAQKGFQDVEAQAATCNHTVMALMASLDAEKAQGQKKVEELEGEITTLNHKLQDASAEVERLRRENQVLSVRIAD
KKYYPSSQDSSSAAAPQLLIVLLGLSALLQ

FIGURE 368

```
CAGCCGTGCTCGAAGCGTTCCTGGAGCCCAAGCTCTCCTCCACAGGTGAAGACAGGGCCAGCAGGAGACACCATG

GGGCACCTCTCAGCCCCACTTCACAGAGTGCGTGTACCCTGGCAGGGGCTTCTGCTCACAGCCTCACTTCTAACC
TTCTGGAACCCGCCCACCACTGCCCAGCTCACTACTGAATCCATGCCATTCAATGTTGCAGAGGGGAAGGAGGTT
CTTCTCCTTGTCCACAATCTGCCCCAGCAACTTTTTGGCTACAGCTGGTACAAAGGGGAAAGAGTGGATGGCAAC
CGTCAAATTGTAGGATATGCAATAGGAACTCAACAAGCTACCCCAGGGCCCGCAAACAGCGGTCGAGAGACAATA
TACCCCAATGCATCCCTGCTGATCCAGAACGTCACCCAGAATGACACAGGATTCTACACCCTACAAGTCATAAAG
TCAGATCTTGTGAATGAAGAAGCAACTGGACAGTTCCATGTATACCCGGAGCTGCCCAAGCCCTCCATCTCCAGC
AACAACTCCAACCCTGTGGAGGACAAGGATGCTGTGGCCTTCACCTGTGAACCTGAGACTCAGGACACAACCTAC
CTGTGGTGGATAAACAATCAGAGCCTCCCGGTCAGTCCCAGGCTGCAGCTGTCCAATGGCAACAGGACCCTCACT
CTACTCAGTGTCACAAGGAATGACACAGGACCCTATGAGTGTGAAATACAGAACCCAGTGAGTGCGAACCGCAGT
GACCCAGTCACCTTGAATGTCACCTATGGCCCGGACACCCCCACCATTTCCCCTTCAGACACCTATTACCGTCCA
GGGGCAAACCTCAGCCTCTCCTGCTATGCAGCCTCTAACCCACCTGCACAGTACTCCTGGCTTATCAATGGAACA
TTCCAGCAAAGCACACAAGAGCTCTTTATCCCTAACATCACTGTGAATAATAGTGGATCCTATACCTGCCACGCC
AATAACTCAGTCACTGGCTGCAACAGGACCACAGTCAAGACGATCATAGTCACTGATAATGCTCTACCACAAGAA
AATGGCCTCTCACCTGGGGCCATTGCTGGCATTGTGATTGGAGTAGTGGCCCTGGTTGCTCTGATAGCAGTAGCC
CTGGCATGTTTTCTGCATTTCGGGAAGACCGGCAGGGCAAGCGACCAGCGTGATCTCACAGAGCACAAACCCTCA
GTCTCCAACCACACTCAGGACCACTCCAATGACCCACCTAACAAGATGAATGAAGTTACTTATTCTACCCTGAAC
TTTGAAGCCCAGCAACCCACACAACCAACTTCAGCCTCCCCATCCCTAACAGCCACAGAAATAATTTATTCAGAA
GTAAAAAAGCAGTAATGAAACCTGTCCTGCTCACTGCAGTGCTGATGTATTTCAAGTCTCTCACCCTCATCACTA
GGAGATTCCTTTCCCCTGTAGGGTAGAGGGGTGGGGACAGAAACAACTTTCTCCTACTCTTCCTTCCTAATAGGC
ATCTCCAGGCTGCCTGGTCACTGCCCCTCTCTCAGTGTCAATAGATGAAAGTACATTGGGAGTCTGTAGGAAACC
CAACCTTCTTGTCATTGAAATTTGGCAAAGCTGACTTTGGGAAAGAGGGACCAGAACTTCCCCTCCCTTCCCCTT
TTCCCAACCTGGACTTGTTTTAAACTTGCCTGTTCAGAGCACTCATTCCTTCCCACCCCCAGTCCTGTCCTATCA
CTCTAATTCGGATTTGCCATAGCCTTGAGGTTATGTCCTTTTCCATTAAGTACATGTGCCAGGAAACAGCGAGAG
AGAGAAAGTAAACGGCAGTAATGCTTCTCCTATTTCTCCAAAGCCTTGTGTGAACTAGCAAAGAGAAGAAAATCA
AATATATAACCAATAGTGAAATGCCACAGGTTTGTCCACTGTCAGGGTTGTCTACCTGTAGGATCAGGGTCTAAG
CACCTTGGTGCTTAGCTAGAATACCACCTAATCCTTCTGGCAAGCCTGTCTTCAGAGAACCCACTAGAAGCAACT
AGGAAAAATCACTTGCCAAAATCCAAGGCAATTCCTGATGGAAAATGCAAAAGCACATATATGTTTAATATCTT
TATGGGCTCTGTTCAAGGCAGTGCTGAGAGGGAGGGGTTATAGCTTCAGGAGGGAACCAGCTTCTGATAAACACA
ATCTGCTAGGAACTTGGGAAAGGAATCAGAGAGCTGCCCTTCAGCGATTATTTAAATTGTTAAAGAATACACAAT
TTGGGGTATTGGGATTTTTCTCCTTTTCTCTGAGACATTCCACCATTTTAATTTTTGTAACTGCTTATTTATGTG
AAAAGGGTTATTTTTACTTAGCTTAGCTATGTCAGCCAATCCGATTGCCTTAGGTGAAAGAAACCACCGAAATCC
CTCAGGTCCCTTGGTCAGGAGCCTCTCAAGATTTTTTTTGTCAGAGGCTCCAAATAGAAAATAAGAAAAGGTTTT
CTTCATTCATGGCTAGAGCTAGATTTAACTCAGTTTCTAGGCACCTCAGACCAATCATCAACTACCATTCTATTC
CATGTTTGCACCTGTGCATTTTCTGTTTGCCCCCATTCACTTTGTCAGGAAACCTTGGCCTCTGCTAAGGTGTAT
TTGGTCCTTGAGAAGTGGGAGCACCCTACAGGGACACTATCACTCATGCTGGTGGCATTGTTTACAGCTAGAAAG
CTGCACTGGTGCTAATGCCCCTTGGGAAATGGGGCTGTGAGGAGGAGGATTATAACTTAGGCCTAGCCTCTTTTA
ACAGCCTCTGAAATTTATCTTTTCTTCTATGGGGTCTATAAATGTATCTTATAATAAAAAGGAAGGACAGGAGGA
AGACAGGCAAATGTACTTCTCACCCAGTCTTCTACACAGATGGAATCTCTTTGGGGCTAAGAGAAAGGTTTTATT
CTATATTGCTTACCTGATCTCATGTTAGGCCTAAGAGGCTTTCTCCAGGAGGATTAGCTTGGAGTTCTCTATACT
CAGGTACCTCTTTCAGGGTTTTCTAACCCTGACACGGACTGTGCATACTTTCCCTCATCCATGCTGTGCTGTGTT
ATTTAATTTTTCCTGGCTAAGATCATGTCTGAATTATGTATGAAAATTATTCTATGTTTTATAATAAAAATAAT
ATATCAGACATCGAAAAAAAAAA
```

FIGURE 369

MGHLSAPLHRVRVPWQGLLLTASLLTFWNPPTTAQLTTESMPFNVAEGKEVLLLVHNLPQQLFGYSWYKGERVDG
NRQIVGYAIGTQQATPGPANSGRETIYPNASLLIQNVTQNDTGFYTLQVIKSDLVNEEATGQFHVYPELPKPSIS
SNNSNPVEDKDAVAFTCEPETQDTTYLWWINNQSLPVSPRLQLSNGNRTLTLLSVTRNDTGPYECEIQNPVSANR
SDPVTLNVTYGPDTPTISPSDTYYRPGANLSLSCYAASNPPAQYSWLINGTFQQSTQELFIPNITVNNSGSYTCH
ANNSVTGCNRTTVKTIIVTDNALPQENGLSPGAIAGIVIGVVALVALIAVALACFLHFGKTGRASDQRDLTEHKP
SVSNHTQDHSNDPPNKMNEVTYSTLNFEAQQPTQPTSASPSLTATEIIYSEVKKQ

FIGURE 370

ATGGCGAACGCGAGCGAGCCGGGTGGCAGCGGCGGCGGCGAGGCGGCCGCCCTGGGCCTCAAGCTGGCCACGCTC
AGCCTGCTGCTGTGCGTGAGCCTAGCGGGCAACGTGCTGTTCGCGCTGCTGATCGTGCGGGAGCGCAGCCTGCAC
CGCGCCCCGTACTACCTGCTGCTCGACCTGTGCCTGGCCGACGGGCTGCGCGCGCTCGCCTGCCTCCCGGCCGTC
ATGCTGGCGGCGCGGCGTGCGGCGGCCGCGGCGGGGGCGCCGCCGGGCGCGCTGGGCTGCAAGCTGCTCGCCTTC
CTGGCCGCGCTCTTCTGCTTCCACGCCGCCTTCCTGCTGCTGGGCGTGGGCGTCACCCGCTACCTGGCCATCGCG
CACCACCGCTTCTATGCAGAGCGCCTGGCCGGCTGGCCGTGCGCCGCCATGCTGGTGTGCGCCGCCTGGGCGCTG
GCGCTGGCCGCGGCCTTCCCGCCAGTGCTGGACGGCGGTGGCGACGACGAGGACGCGCCGTGCGCCCTGGAGCAG
CGGCCCGACGGCGCCCCCGGCGCGCTGGGCTTCCTGCTGCTGCTGGCCGTGGTGGTGGGCGCCACGCACCTCGTC
TACCTCCGCCTGCTCTTCTTCATCCACGACCGCCGCAAGATGCGGCCCGCGCGCCTGGTGCCCGCCGTCAGCCAC
GACTGGACCTTCCACGGCCCGGGCGCCACCGGCCAGGCGACCGCCAACTGGACGGCGGGCTTCGGCCGCGGGCCC
ACGCCGCCCGCGCTTGTGGGCATCCGGCCCGCAGGGCCGGGCCGCGGCGCGCGCCGCCTCCTCGTGCTGGAAGAA
TTCAAGACGGAGAAGAGGCTGTGCAAGATGTTCTACGCCGTCACGCTGCTCTTCCTGCTCCTCTGGGGCCCTAC
GTCGTGGCCAGCTACCTGCGGGTCCTGGTGCGGCCCGGCGCCGTCCCCCAGGCCTACCTGACGGCCTCCGTGTGG
CTGACCTTCGCGCAGGCCGGCATCAACCCCGTCGTGTGCTTCCTCTTCAACAGGGAGCTGAGGGACTGCTTCAGG
GCCCAGTTCCCCTGCTGCCAGAGCCCCCGGACCACCCAGGCGACCCATCCCTGCGACCTGAAAGGCATTGGTTTA
TGAGGGAGGCCCCGCCACATAGACCCCCAACCCAGCCTTTCCCTTTGGCTCGGACGGTGACGTTGTATCTTTTCC
TTCTGGCCCCTGTTTAATTTTCTAAGCTGCCTTCAAAATGACTCGAAGTGGACAGACACTTGGATTGTACTGACT
CCTTTGGGGGTGGGGTGGGTGAGGAGTAGGATGCTCAGCCCACTCCAGCTCCGCACATTCGTCCTCCTAACTCGA
CTTTCTTCCTGACAATAGGCCCTGCAGTCTTTTTGTAGCGGTACTGACGTCTTTTATTCCATGTGTGGTTCCTTT
TTTTCTTTTTCTATAAAGGCTGTACTAATTTTCTTCATGCAACGTTTCCTAAAGACCATGGCCAGTTTTCTACAG
AAGCTATTTTTGACAACCTCAAGTGGCATTACATTTGCAGTGAAGTAGAGGAACCTAGGGGGACTTCTTCACAA
GTTAGATTTCTTGAGGATCTTCTGTTGGAAGCAGGAGAAAGTGGGGGGTGGGGGGAAGTTGTCCGAAATGCCCTC
TGAATTGCCGGCTGCAGGGTCCTTGTGCTGCGCTGGTTCTTTGAAAGTCTCAGTGTTGATATTGAACTTAAAGAG
CAGAGATGGAGATCAGTAGCAAGGCAGTCATTTTTTAAAGCAGTAAGTAACAAGTAAGATTTGGTTCCCGGTTT
ACTTCTGCTGCTAAAAACCACGTCAGTGACAACTGCTCTCTGTATTATAGCAATCTTGAATGGAAACATTTCTG
TCAAGTTGTAAGTTTTAAAAGAGTAAAGTGTTTTGGTTAGTAATGATGTGGAGAAAAATACAGTATTGCATGTGT
TCGTGTGTATAGATTGTGGTTCGAGGATTGGGAGGGCTCTGAGAAGCAGAGTACTACATCAAAATTGTTTAAGT
ATTTTTTGCCAATAAAAAATTAATTTTATGGAAATGGCTTGTGCTTTGAAGAGCCCAGTTTTATTCTGTCTTATG
AAACTAATTTCCACTTTGAAAATTGTTCTTCTGTTGTTTATGGTATAAATGAATGGAATATAATGATATCCTCCT
TCTAGGAAACAAAGCATTTCCTTAAAATGTTTGCTAGGTTAAGCTGTGCTGTTCTACTGATGGTTGTTTAAATT
AATAATGAGAACTATAATTTAAATAATATTTCTTTGTTAGACATTATAATGTTAAACTGAAAGACTAAATTCTGC
AAGTACTATATAATATTTTTGGCTTATAATGCTACATTTTTATTAATGTACCTTCCGTTTTGAGGATTTATATCT
GTATTTCTCTTTGCATTATACAAATATACCAGTATTTTCAAAAAAAATCTATGTCGGGTGCGGAGAAAGAGGTAA
TGAAATGGCA

FIGURE 371

```
MANASEPGGSGGGEAAALGLKLATLSLLLCVSLAGNVLFALLIVRERSLHRAPYYLLLDLCLADGLRALACLPAV
MLAARRAAAAAGAPPGALGCKLLAFLAALFCFHAAFLLLGVGVTRYLAIAHHRFYAERLAGWPCAAMLVCAAWAL
ALAAAFPPVLDGGGDDEDAPCALEQRPDGAPGALGFLLLLAVVVGATHLVYLRLLFFIHDRRKMRPARLVPAVSH
DWTFHGPGATGQATANWTAGFGRGPTPPALVGIRPAGPGRGARRLLVLEEFKTEKRLCKMFYAVTLLFLLLWGPY
VVASYLRVLVRPGAVPQAYLTASVWLTFAQAGINPVVCFLFNRELRDCFRAQFPCCQSPRTTQATHPCDLKGIGL
```

FIGURE 372A

```
GAATCTTTCCATGCCGCTGGAGCTCATCTGCTCCGATGAGCACATGCAAGGCAGCGGGAGCCTGGCCCAGGCTGT
CATCAGGGAAGTCAGAGCCCAGTGGAGTCGGATTTTCTCCACCGCACTCTTCGTGGAGCACGTGCTCCTAGGAAC
CGAGAGCCGCGTCCCCGAGTTACAGGGGCTGGTGACCGAGCACGTCTTCTTACTAGACAAGTGTCTTCGAGAGAA
CTCTGACGTGAAGACGCACGGGCCTTTTGAGGCCGTGATGCGCACTCTCTGTGAATGCAAGGAGACAGCCAGCAA
GACCCTCAGCAGGTTTGGGATTCAGCCGTGCTCCATCTGCCTGGGAGATGCAAAGGACCCCGTCTGTCTGCCCTG
CGACCACGTGCACTGCCTGCGCTGCCTCAGGGCCTGGTTTGCCTCAGAGCAGATGATATGCCCCTACTGTTTAAC
TGCCTTGCCAGACGAATTCTCTCCAGCTGTTTCCCAAGCGCACAGGGAAGCCATTGAAAAGCATGCCCGCTTCCG
GCAGATGTGCAACAGTTTCTTCGTAGACCTGGTGTCCACCATTTGCTTCAAGGACAACGCTCCGCCTGAGAAGGA
AGTGATTGAGAGCCTGCTCTCTCCTCTTCGTCCAAAAGGGGCGCTTAAGAGATGCTGCCCAGAGACACTGTGA
ACACACAAAATCTCTCTCCATTCAATGATGTTGTGGATAAGACTCCTGTCATCCGCTCAGTGATACTGAAACT
GCTTTTGAAGTACAGCTTTCATGATGTAAAAGATTATATTCAGGAATATTTGACCCTGTTAAAAAAGAAAGCATT
CATAACTGAAGATAAAACTGAACTGTACATGCTCTTCATCAACTGCCTGGAGGATTCAATACTTGAGAAGACCAG
TGCTTACTCCAGAAATGATGAACTGAACCACCTAGAAGAGGAAGGTCGTTTCCTTAAGGCATATTCTCCAGCAAG
CCGGGGCCGAGAGCCTGCCAACGAGGCCTCGGTTGAATACCTGCAAGAGGTGGCCCGGATCCGCCTCTGCCTCGA
CAGAGCTGCAGATTTCCTCTCGGAGCCTGAGGGAGCCCAGAGATGGCCAAGGAGAAGCAGTGCTACCTGCAGCA
AGTCAAGCAGTTCTGTATCCGGTGGAGAACGACTGGCACCGGGTGTACCTGGTGCGGAAGCTCAGCAGCCAGCG
GGGGATGGAGTTCGTGCAGGGCCTCTCCAAGCCCGGCCGCCCGCACCAGTGGGTGTTTCCCAAGGACGTTGTCAA
GCAGCAGGGGCTGCGGCAGGACCACCCAGGCCAGATGGATAGGTACCTGGTGTACGGCGATGAATACAAGGCTCT
CCGTGATGCTGTGGCCAAAGCTGTCCTCGAGTGCAAGCCACTGGGCATTAAGACTGCTCTGAAGGCCTGCAAGAC
CCCCCAAAGCCAGCAGTCAGCCTACTTCCTGTTAACACTGTTTAGAGAGGTGGCTATTTGTACAGATCCCACAA
TGCAAGCCTCCACCCCACGCCAGAGCAATGTGAAGCTGTGAGCAAATTCATTGGCGAATGCAAGATCCTTTCACC
TCCTGATATCAGCCGTTTTGCAACATCGCTCGTGGACAATTCTGTGCCATTGTTGAGGGCGGGGCCTAGTGACAG
CAACCTTGATGGAACGGTGACAGAAATGGCCATTCATGCTGCAGCCGTCCTTCTGTGTGGACAGAATGAACTCTT
GGAGCCCCTAAAGAATCTGGCCTTCTCCCCAGCCACCATGGCGCATGCTTTTCTTCCAACCATGCCTGAAGACTT
GCTGGCTCAAGCTCGGAGGTGGAAGGGTCTGGAGCGAGTCCACTGGTACACTTGTCCCAACGGCCATCCTTGCTC
CGTGGGAGAGTGTGGCAGGCCGATGGAACAGAGCATCTGCATTGACTGCCATGCGCCGATTGGAGGCATTGACCA
CAAACCTCGGGACGGCTTTCATCTGGTCAAAGACAAGGCAGACAGAACGCAGACCGGCCATGTGCTGGGCAACCC
GCAGCGGAGAGACGTGGTGACATGTGACCGAGGGCTGCCCCAGTGGTCTTCCTCCTTATCCGGCTACTCACTCA
CTTGGCTCTGCTTCTGGGAGCGTCCCAGAGTTCCCAGGCTCTGATAAACATCATTAAGCCTCCAGTGAGGGATCC
AAAAGGCTTTCTGCAGCAGCACATCCTGAAGGACCTGGAGCAGTTGGCCAAGATGCTGGGACACAGTGCCGACGA
GACCATCGGCGTGGTCCACCTCGTCCTGCGCAGGCTTCTCCAAGAGCAGCACCAGCTCTCTAGCAGAAGGCTTTT
AAATTTTGACACAGAATTGTCAACTAAAGAAATGAGGAACAACTGGGAAAAGGAAATCGCAGCTGTGATTTCTCC
TGAACTGGAGCATCTAGATAAAACCCTTCCCACCATGAATAATCTCATCAGCCAAGATAAGCGTATCAGCTCTAA
CCCTGTGGCCAAAATAATATATGGTGACCCAGTGACCTTCCTGCCCCACCTGCCCCGGAAAAGTGTGGTCCATTG
CTCTAAGATTTGGAGCTGCAGGAAAAGAATTACAGTTGAGTACCTCCAGCACATTGTGGAACAGAAAAATGGCAA
AGAAAGAGTGCCCATCCTCTGGCATTTCCTGCAGAAGGAAGCAGAGCTGAGGCTGGTAAAGTTCCTGCCTGAGAT
TTTGGCCTTGCAAAGGGATCTAGTGAAGCAGTTCCAGAACGTCCAGCAAGTTGAATACAGCTCCATCAGAGGCTT
CCTCAGCAAGCACAGCTCAGATGGGTTGAGGCAGCTGCTTCACAACAGGATCACAGTCTTTCTGTCCACATGGAA
CAAACTGAGGAGATCGCTTGAGACGAACGGTGAGATCAACCTACCCAAAGACTACTGCAGCACTGACTTGGATCT
GGACACTGAGTTTGAGATCCTCTTGCCACGCCGACGGGCCTGGGCCTCTGTGCTACCGCTCTCGTCAGCTACTT
GATTCGCCTACACAATGAAATTGTCTACGCCGTGGAAAAACTCTCCAAGGAAAACAACAGCTATTCCGTGGATGC
CGCCGAGGTCACTGAACTGCATGTCATCAGTTATGAAGTGGAGCGGGACCTGACTCCACTGATTCTCTCCAACTG
CCAGTACCAGGTGGAGGAGGGCAGAGAGACCGTGCAGGAGTTCGATCTGGAGAAGATTCAGCGGCAGATCGTCAG
CCGCTTCCTCCAGGGCAAGCCCCGGCTGAGCCTCAAGGGAATACCCACTCTGGTGTACAGACACGACTGGAACTA
TGAACATCTCTTTATGGACATCAAGAACAAAATGGCACAGGACTCCCTCCCCAGCTCGGTCATTAGTGCCATCAG
TGGACAGCTGCAGTCCTACAGCGATGCCTGTGAAGTGCTGTCTGTCGTAGAAGTCACTCTGGGGTTTCTGAGCAC
AGCTGGTGGGGATCCAAACATGCAGCTGAATGTGTATACTCAAGACATCCTGCAAATGGGTGATCAGACGATTCA
CGTGTTAAAGGCCTTAAACAGATGCCAGTTAAAACACACCATTGCCCTCTGGCAGTTCCTGTCTGCTCATAAGTC
```

FIGURE 372B

```
TGAACAGCTGCTGCGGCTGCACAAAGAGCCATTTGGGGAAATCAGTTCAAGGTACAAAGCGGATCTGAGCCCGGA
AAATGCTAAGCTCCTCAGCACATTCCTAAATCAGACTGGCCTAGACGCCTTCCTGCTAGAGCTGCACGAAATGAT
AATCTTGAAACTAAAGAACCCCCAAACCCAAACCGAGGAGCGCTTCCGCCCTCAGTGGAGCCTGAGAGACACTCT
CGTAAGTTACATGCAAACTAAAGAAAGTGAAATTCTTCCTGAAATGGCATCTCAGTTCCCAGAAGAGATACTGCT
CGCCAGCTGTGTCTCAGTGTGGAAAACAGCTGCTGTGCTGAAATGGAATCGAGAAATGAGATAGAATTATTTCCT
CAGCTATCTTTGGATGACTTTGGAGAGAAGACTCCTCTCTCCTCGTCTGCGGCGTGGACTTGATCATGGACTGGT
GCCTTTGCATTCAGAAGGAGAGCTGTCAGCGTAGCACCGAATTCAAGACCAAGGCGTGCTACCTGAGCTGACAGC
TTTTTGAAAGCCGAGCTGTTTCTGAACCATGTACATACATGTTCTGAAACTTTCTCATCATTTTATGAGTACTGT
TCATTGAGAGATGACAATGAAGATTAGATGAAATTGGAAATAAACCAACATTGTTTACATTCCAGGAGACTTGTA
GCTCAGCCACACACGCAGTAATGACCTGTGCCCGTTCGCCTCTGGCACTGCCCACCCCTCTTTTTTTTTTCTTC
TAATTCTGTACTCACAAAAGAGAATCTCATTTTCTTCTTTCTTCCATTCCCTTAAATTCTGAGTACTGTACATAT
ATTTCTGGGTTCCCACGATGATGTGAAAAACTACCAGACTGTTTTTTGTCTTCTCACAAAGACAAGAAAAATCAG
GGCATTTTGTGAGTGCCTTAAGATCAAACTAACAAGATCTGACCCTCTCCCCTCACAGTGAGCCACTGCCCCACT
TCAGAGGGTAAGAGCCAAAAGCCTCATTGTGAAAGGCACTGGACTTGGACCAGGGACACCATCAGGGCCTTGGTT
TTCTCACGCATAAAATGGAGAGTGGATTAATCGCCAAAGATTCTTCTGATCTGACATTTTGAAATTGTGAGAGAA
ACTAGATGACTGTAAACTTGGTCACAGGCCTGGTTCTGGCAGTTCTTTGCGGACTTTTTCTAGCATTATGCCAA
ATAAACATGCAGTCTCAGTGTGCTCTCGCATGTATGAATATCTAGTCCTTTCTGTGGTTCTCAGCCAAGACATAA
AAACTAGGACTCAGAGCACATACAAAACCAGTTATGTTTCGGAAAGAGGGAAAAGAGTCCCCGAGCCCGGATCTT
GTGCTGCTTTTCTCACTGACGTGTTGCCTTTTTTCTTTACAAAATCTGCTTTGATACTTAGGACCTCTCTGGACT
AATTTCTCTTCCTAGACAGCTCAGCACAGCTATTGATATGTTAGAGGCAGTATCCTTAATATTCATTCTAAATGA
GTTAACGACTTAACTTGAAATTGGGCCTAAGGAGTGAGAACTACAAAAATACAAAATGCTTGTCCAGGACTCAGC
CATGCACACCTTGAGCAGCGCCGGCAGGAGGCACGGAAGGAACTGTGCTCCGTTCTCCTCACTGTCATGGTGCCA
CCAGTGTCTGATGAAGGGCAGAGTGACCCAGACTGCAGGCAGTAACTGACTTCACACAGTCCCTGGCATTTAGTC
ATCTGTGATTGTTTTATCACTCTGGACTGTGCAGAGCCACCTGCCACCGAGATCTGCATTCCGACTGCCTATGAA
CGGGTGTGGGGGCCGGGGCTGGCTTGCTGAAGTCTTCAACTTGCACTCGGAGCTCCTTTGATACCTCAGAGCTG
GCTGTCAGGTGGCAGCTCACACCCAGACTCACTGGCCACACCTCAGCAGGGGGGAGTCGAGTGTCAGTCTCTTT
CTGTGAAGGCTTTTTTTTTCCTTTGGCCTGGGAATTTTTCCCATTTTTATGAAGGGGTTTTAAATTGTTTCATTT
TGTGTGCTGTGCTTCAAAGCCTTAACTGTCAAATCTTGCATTATCTTGTTTGTACAGAAATATACTGGCCTAGCA
GAGGC
```

FIGURE 373

```
GTGGCTTGGTATTCACTGGCAGGTTTCAGACATTTAGATCTTTCTTTTAATGACTAACACCATGCCTATCTGTGG
AGAAGCTGGCAACATGTCACACCTGGAAATTGTTTTCAACATTAATACTATTATTTGGCAGTAATCCAGATTGC
TTTTGCCACCAACCTGAAGACATATAGAGGCAGAAGGACAGGAATAATTCTATTTGTTTCCTGTTTTGAAACTTC
CATCTGTAAGGCTATCAAAAGGAGATGTGAGAGAGGGTATTGAGTCTGGCCTGACAATGCAGTTCTTAAACCAAA
GGTCCATTATGCTTCTCCTCTCTGAGAATCCTGACTTACCTCAACAACGGAGACATGGCACAGTAGCCAGCTTGG
AGACTTCTCAGCCAATGCTCTGAGATCAAGTCGAAGACCCAATATACAGGGTTTTGAGCTCATCTTCATCATTCA
TATGAGGAAATAAGTGGTAAAATCCTTGGAAATACAATGAGACTCATCAGAAACATTTACATATTTTGTAGTATT
GTTATGACAGCAGAGGGTGATGCTCCAGAGCTGCCAGAAGAAAGGGAACTGATGACCAACTGCTCCAACATGTCT
CTAAGAAAGGTTCCCGCAGACTTGACCCCAGCCACAACGACACTGGATTTATCCTATAACCTCCTTTTTCAACTC
CAGAGTTCAGATTTTCATTCTGTCTCCAAACTGAGAGTTTTGATTCTATGCCATAACAGAATTCAACAGCTGGAT
CTCAAAACCTTTGAATTCAACAAGGAGTTAAGATATTTAGATTTGTCTAATAACAGACTGAAGAGTGTAACTTGG
TATTTACTGGCAGGTCTCAGGTATTTAGATCTTTCTTTTAATGACTTTGACACCATGCCTATCTGTGAGGAAGCT
GGCAACATGTCACACCTGGAAATCCTAGGTTTGAGTGGGGCAAAAATACAAAAATCAGATTTCCAGAAAATTGCT
CATCTGCATCTAAATACTGTCTTCTTAGGATTCAGAACTCTTCCTCATTATGAAGAAGGTAGCCTGCCCATCTTA
AACACAACAAAACTGCACATTGTTTTACCAATGGACACAAATTTCTGGGTTCTTTTGCGTGATGGAATCAAGACT
TCAAAAATATTAGAAATGACAAATATAGATGGCAAAAGCCAATTTGTAAGTTATGAAATGCAACGAAATCTTAGT
TTAGAAAATGCTAAGACATCGGTTCTATTGCTTAATAAAGTTGATTTACTCTGGGACGACCTTTTCCTTATCTTA
CAATTTGTTTGGCATACATCAGTGGAACACTTTCAGATCCGAAATGTGACTTTTGGTGGTAAGGCTTATCTTGAC
CACAATTCATTTGACTACTCAAATACTGTAATGAGAACTATAAAATTGGAGCATGTACATTTCAGAGTGTTTTAC
ATTCAACAGGATAAAATCTATTTGCTTTTGACCAAAATGGACATAGAAAACCTGACAATATCAAATGCACAAATG
CCACACATGCTTTTCCCGAATTATCCTACGAATTCCAATATTTAAATTTTGCCAATAATATCTTAACAGACGAG
TTGTTTAAAAGAACTATCCAACTGCCTCACTTGAAAACTCTCATTTTGAATGGCAATAAACTGGAGACACTTTCT
TTAGTAAGTTGCTTTGCTAACAACACACCCTTGGAACACTTGGATCTGAGTCAAAATCTATTACAACATAAAAAT
GATGAAAATTGCTCATGGCCAGAAACTGTGGTCAATATGAATCTGTCATACAATAAATTGTCTGATTCTGTCTTC
AGGTGCTTGCCCAAAAGTATTCAAATACTTGACCTAAATAATAACCAAATCCAAACTGTACCTAAAGAGACTATT
CATCTGATGGCCTTACGAGAACTAAATATTGCATTTAATTTTCTAACTGATCTCCCTGGATGCAGTCATTTCAGT
AGACTTTCAGTTCTGAACATTGAAATGAACTTCATTCTCAGCCCATCTCTGGATTTTGTTCAGAGCTGCCAGGAA
GTTAAAACTCTAAATGCGGGAAGAAATCCATTCCGGTGTACCTGTGAATTAAAAAATTTCATTCAGCTTGAAACA
TATTCAGAGGTCATGATGGTTGGATGGTCAGATTCATACACCTGTGAATACCCTTTAAACCTAAGGGGAATTAGG
TTAAAAGACGTTCATCTCCACGAATTATCTTGCAACACAGCTCTGTTGATTGTCACCATTGTGGTTATTATGCTA
GTTCTGGGGTTGGCTGTGGCCTTCTGCTGTCTCCACTTTGATCTGCCCTGGTATCTCAGGATGCTAGGTCAATGC
ACACAAACATGGCACAGGGTTAGGAAAACAACCCAAGAACAACTCAAGAGAAATGTCCGATTCCACGCATTTATT
TCATACAGTGAACATGATTCTCTGTGGGTGAAGAATGAATTGATCCCCAATCTAGAGAAGGAAGATGGTTCTATC
TTGATTTGCCTTTATGAAAGCTACTTTGACCCTGGCAAAAGCATTAGTGAAAATATTGTAAGCTTCATTGAGAAA
AGCTATAAGTCCATCTTTGTTTTGTCTCCCAACTTTGTCCAGAATGAGTGGTGCCATTATGAATTTTACTTTGCC
CACCACAATCTCTTCCATGAAAATTCTGATCATATAATTCTTATCTTACTGGAACCCATTCCATTCTATTGCATT
CCCACCAGGTATCATAAACTGAAAGCTCTCCTGGAAAAAAAGCATACTTGGAATGGCCCAAGGATAGGCGTAAA
TGTGGGCTTTTCTGGGCAAACCTTCGAGCTGCTATTAATGTTAATGTATTAGCCACCAGAGAAATGTATGAACTG
CAGACATTCACAGAGTTAAATGAAGAGTCTCGAGGTTCTACAATCTCTCTGATGAGAACAGATTGTCTATAAAAT
CCCACAGTCCTTGGGAAGTTGGGGACCACATACACTGTTGGGATGTACATTGATACAACCTTTATGATGGCAATT
TG
```

FIGURE 374

MRLIRNIYIFCSIVMTAEGDAPELPEERELMTNCSNMSLRKVPADLTPATTTLDLSYNLLFQLQSSDFHSVSKLR
VLILCHNRIQQLDLKTFEFNKELRYLDLSNNRLKSVTWYLLAGLRYLDLSFNDFDTMPICEEAGNMSHLEILGLS
GAKIQKSDFQKIAHLHLNTVFLGFRTLPHYEEGSLPILNTTKLHIVLPMDTNFWVLLRDGIKTSKILEMTNIDGK
SQFVSYEMQRNLSLENAKTSVLLLNKVDLLWDDLFLILQFVWHTSVEHFQIRNVTFGGKAYLDHNSFDYSNTVMR
TIKLEHVHFRVFYIQQDKIYLLLTKMDIENLTISNAQMPHMLFPNYPTKFQYLNFANNIITDELFKRTIQLPHLK
TLILNGNKLETLSLVSCFANNTPLEHLDLSQNLLQHKNDENCSWPETVVNMNLSYNKLSDSVFRCLPKSIQILDL
NNNQIQTVPKETIHLMALRELNIAFNFLTDLPGCSHFSRLSVLNIEMNFILSPSLDFVQSCQEVKTLNAGRNPFR
CTCELKNFIQLETYSEVMMVGWSDSYTCEYPLNLRGIRLKDVHLHELSCNTALLIVTIVVIMLVLGLAVAFCCLH
FDLPWYLRMLGQCTQTWHRVRKTTQEQLKRNVRFHAFISYSEHDSLWVKNELIPNLEKEDGSILICLYESYFDPG
KSISENIVSFIEKSYKSIFVLSPNFVQNEWCHYEFYFAHHNLFHENSDHIILILLEPIPFYCIPTRYHKLKALLE
KKAYLEWPKDRRKCGLFWANLRAAINVNVLATREMYELQTFTELNEESRGSTISLMRTDCL

FIGURE 375

```
AGCTCGGTCCTGCTGGAGGCCACGGGTGCCACACACTCGGTCCCGACATGATGGCGAGCATGCGAGTGGTGAAGG
AGCTGGAGGATCTTCAGAAGAAGCCTCCCCCATACCTGCGGAACCTGTCCAGCGATGATGCCAATGTCCTGGTGT
GGCACGCTCTCCTCCTACCCGACCAACCTCCCTACCACCTGAAAGCCTTCAACCTGCGCATCAGCTTCCCGCCGG
AGTATCCGTTCAAGCCTCCCATGATCAAATTCACAACCAAGATCTACCACCCCAACGTGGACGAGAACGGACAGA
TTTGCCTGCCCATCATCAGCAGTGAGAACTGGAAGCCTTGCACCAAGACTTGCCAAGTCCTGGAGGCCCTCAATG
TGCTGGTGAATAGACCGAATATCAGGGAGCCCCTGCGGATGGACCTCGCTGACCTGCTGACACAGAATCCGGAGC
TGTTCAGAAAGAATGCCGAAGAGTTCACCCTCCGATTCGGAGTGGACCGGCCCTCCTAACTCATGTTCTGACCCT
CTGTGCACTGGATCCTCGGCATAGCGGACGGACACACCTCATGGACTGAGGCCAGAGCCCCCTGTGGCCCATTCC
CCATTCATTTTTCCCTTCTTAGGTTGTTAGTCATTAGTTTGTGTGTGTGTGTGGTGGAGGGAAGGGAGCTATGAG
TGTGTGTGTTGTGTATGGACTCACTCCCAGGTTCACCTGGCCACAGGTGCACCCTTCCCACACCCTTTACATTCC
CCAGAGCCAAGGGAGTTTAAGTTTGCAGTTACAGGCCAGTTCTCCAGCTCTCCATCTTAGAGAGACAGGTCACCT
TGCAGGCCTGCTTGCAGGAAATGAATCCAGCAGCCAACTCGAATCCCCCTAGGGCTCAGGCACTGAGGGCCTGGG
GACAGTGGAGCATATGGGTGGGAGACAGATGGAGGGTACCCTATTTACAACTGAGTCAGCCAAGCCACTGATGGG
AATATACAGATTTAGGTGCTAAACCGTTTATTTTCCACGGATGAGTCACAATCTGAAGAATCAAACTTCCATCCT
GAAAATCTATATGTTTCAAAACCACTTGCCATCCTGTTAGATTGCCAGTTCCTGGGACCAGGCCTCAGACTGTGA
AGTATATATCCTCCAGCATTCAGTCCAGGGGAGCCACGGAAACCATGTTCTTGCTTAAGCCATTAAAGTCAGAG
ATGAAAAAAAAAAAAAAAAAAAA
```

FIGURE 376

MMASMRVVKELEDLQKKPPPYLRNLSSDDANVLVWHALLLPDQPPYHLKAFNLRISFPPEYPFKPPMIKFTTKIY
HPNVDENGQICLPIISSENWKPCTKTCQVLEALNVLVNRPNIREPLRMDLADLLTQNPELFRKNAEEFTLRFGVD
RPS

FIGURE 377A

```
CCACGCGTCCGCCGGATCAGAGAGTGCTCCGAGCTGGGTTGCCCCACTGTGCTTGTATCTGCACTCTCCAACACT
AGGCATCATTGACATGTTAAAGCTTAGCCAAATAGAATTGTTCTTTGTCATTCTTTTTTAACTTTTACTTATTC
ATTAGGATGATTTCATAATATATTTCCTGGTTTAGAGGAAACAGGAACAATGGCTACCGAGAGTACTCCCTCAGA
GATCATAGAAAGAGAAAGAAAAAAGTTGCTTGAAATCCTTCAACATGATCCTGATTCTATCTTAGACACGTTAAC
TTCTCGGAGGCTGATTTCTGAGGAAGAGTATGAGACTCTGGAGAATGTTACAGATCTCCTGAAGAAAAGTCGGAA
GCTGTTAATTTTGGTACAGAAAAAGGGAGAGGCGACCTGTCAGCATTTTCTCAAGTGTTTATTTAGTACTTTTCC
ACAGTCAGCTGCCATTTGCGGCTTAAGGCATGAAGTTTTAAAACATGAGAATACAGTACCTCCTCAATCTATGGG
GGCAAGCAGTAATTCAGAAGATGCTTTTTCTCCTGGAATAAAACAGCCTGAAGCCCCTGAGATCACAGTGTTCTT
CAGTGAGAAGGAACACTTGGATTTGGAAACCTCTGAGTTTTTCAGGGACAAGAAAACTAGTTATAGGGAAACAGC
TTTGTCTGCCAGGAAGAATGAGAAGGAATATGACACACCAGAAGTCACATTATCATATTCAGTTGAGAAAGTTGG
ATGTGAAGTTCCAGCAACTATTACATATATAAAAGATGGACAGAGATATGAGGAGCTAGATGATTCTTTATACTT
AGGAAAAGAGGAATATCTAGGATCTGTTGACACCCCTGAAGATGCAGAAGCCACTGTGGAAGAGGAGGTTTATGA
TGACCCAGAGCACGTTGGATATGATGGTGAAGAGGACTTCGAGAATTCAGAAACCACAGAGTTCTCTGGTGAAGA
ACCAAGTTATGAGGGATCAGAAACCAGCCTTTCATTGGAGGAGGAACAGGAGAAAAGTATAGAAGAAAGAAAAAA
GGTGTTTAAAGATGTCCTGTTATGTTTGAACATGGATAGAAGCAGAAAGGTTCTGCCAGATTTTGTTAAACAATT
CTCCTTAGATCGAGGATGTAAGTGGACCCCTGAGAGTCCAGGAGACTTAGCCTGGAATTTCCTGATGAAAGTTCA
AGCACGAGATGTGACGGCTAGGGATTCAATCCTCAGTCACAAGGTTCTGGATGAAGATAGCAAGGAGGATTTGCT
GGCTGGAGTGGAGAATTTGGAAATTCGAGACATACAAACCATTAATCCCCTTGACGTGCTTTGTGCCACCATGCT
GTGTTCAGATAGCTCTTTGCAACGCCAAGTCATGTCAAACATGTATCAGTGCCAGTTTGCTCTTCCCCTGCTACT
GCCAGATGCAGAAAACAACAAAAGCATCTTAATGCTGGGGGCCATGAAAGACATTGTGAAGAAGCAGTCAACACA
GTTTTCAGGGGGGCCTACAGAGGATACAGAAAAGTTTCTGACTCTCATGAAGATGCCTGTCATCTCTTTTGTGCG
TCTAGGATACTGTAGCTTCTCTAAGTCCAGAATCCTCAACACACTTCTCAGCCCTGCCCAGTTGAAATTACACAA
AATCTTTCTTCATCAAGATTTGCCTCTTTTGGTGCTTCCCCGGCAAATCTCTGATGGCCTGGTTGAGATAACATG
GTGTTTTCCTGATAGCGATGATAGAAAGGAAAACCCCTTTTTCCAAAAGCCTGTTGCTCTGGCTAATCTCCGTGG
AAATCTAGAAAGTTTTTGGACTCAGTTTGGTTTTTGATGGAAGTTTCTTCAGCTGTGTTTTTTTCACTGACTG
TTTAGGTGAGAAGGAATGGGACTTGCTAATGTTTTAGGAGAGGCTGCCATTGAAAGATGCTACTTTGTTCTCAG
TTCCCAAGCCAGGGAGAGTGAAGAGGCTCAAATTTTTCAGAGGATACTGAACTTGAAGCCAGCACAGCTACTGTT
TTGGGAGAGGGGAGATGCTGGGGATAGAAGGAAGAACATGGAGGGCCTTCAAGCTGCCCTCCAGGAAGTGATGTT
CTCTTCTTGCCTCAGATGTGTGTCTGTGGAGGATATGGCCGCCCTGGCCAGGGAGCTGGGGATTCAGGTAGATGA
AGACTTTGAAAACACTCAGAGAATTCAAGTTTCCTCTGGAGAAAACATGGCTGGGACAGCTGAAGGTGAGGGTCA
GCAAAGACACAGTCAGCTAAAAAGCTCATCTAAAAGCCAGGCTCTAATGCCAATTCAAGAGCCTGGGACTCAATG
TGAGCTCAGCCAGAATCTTCAGAATCTCTATGGTACCCAGTATTCAGGCCTGTTCTAGAGAACTCCTGGCTCTT
TCCAACCAGAATTGGAGGTAACTTTAACCATGTTTCCTTGAAAGCCTCCTGGGTTATGGGCCGCCCCTTTGGGTC
AGAGCAGAGGCCTAAGTGGTTCCATCCTTTGCCTTTTCAGAATGCAGGGGCCCAGGGCCGAGGTAAAAGTTTTGG
TATTCAATCCTTCCATCCCCAGATATTTTATTCAGGTGAAAGATTCATGAAATTTTCCAGAGTTGCTCGGGGATG
TCACTCGAATGGAACATTTGGGAGACTGCCAAGACCCATTGTCAGCATGTACAGGCCTGCCCTGAGAGACCACA
AATGATGGGAACTCTTGAAAGGTCTAGGGCAGTAGCCTCCAAGATAGTCACTCCTATTCCCTGGATTCACAGCC
AGCAAGAGCAGTAGGGAAGCCATGGCCTCAGCAAGCTTGCACCAGGGTAACAGAGTTAACTGAAGCAACTGGAAA
ACTGATAAGAACATCCCATATTGGAAAGCCTCACCCTCAGTCCTTTCAACCAGCAGCAGCCACACAAAAACTAAG
ACCTGCTTCTCAGCAAGGAGTCCAGATGAAGACACAAGGTGGGGCTTCAAATCCAGCTCTCCAAATAGGGTCCCA
TCCCATGTGCAAGAGCTCTCAGTTCAAATCCGATCAGTCCAACCCATCCACAGTCAAACACTCCCAGCCTAAACC
CTTCCATTCTGTGCCCTCTCAACCTAAATCCTCTCAGACAAAATCCTGTCAGTCCCAGCCCTCCCAAACTAAACC
TTCTCCATGCAAATCTACTCAGCCTAAGCCAAGCCAGCCCTGGCCTCCCCAGTCTAAGCCTTCTCAGCCCAGACC
CCCTCAACCTAAGTCATCCTCAACCAATCCTTCACAAGCTAAGGCACACCACTCAAAAGCAGGGCAGAAGAGGGG
AGGGAAGCATTAAAGAGCTAACTCCAGAGATCTATAAAGCATATCCTTTACCCAGGCCATTCCTATCATATAGTA
AGCAGAAGAGTTGCCATGAAAGTAAAAGACTACTGTCATTAGCATGTAAAACAAAGAAAGATATACATGACCGAA
TTGGATATCTTTGTTTGTTTGTTTGAGACAGAGTTTCACTCTTGTTGCCCAGGCTGGAGTGCAATGGCACGATCT
CGGCTCACCGCAACCTCTGCTTCCTGGCTTAAAGTGATTCTCCTGCCTCAGCCTCTCGAGTAGCTGGGATTACAG
```

FIGURE 377B

```
GCATGCACCACCACACCCAGCTAATTTTGTATTTTTAGTAGAGGCAGGGTTTCTCCATGTTGGTCAGGCTGGTCT
TGAACTCCCGACCTCAGGTGATCCGCCCACCTAGGCCTCTCAAAGTGTTGGGATTACGTGTGTAAGCCACAGTGC
CCAGCCCGAATTGGATATCTTTAAGATATCTGTAAGTGTTATATCCCTAACCAAGAAGAAAAATATGAAAATAAT
TAAGACTAGAATCAAGCAGTAGATAATTGAATCCAATCTTGGGTATTATTAGATAATGTATAACTTGCACCCAGG
GAATGGGGGTCTATGAGACAACCCCACTTGGAGAAGAATGGGGTTAGGGTCTCTAATTGCAAAGTGACTGTACAA
TAGGACGAAAGTTGCCTCTGTGTCTGAGAAAGTATCTTAGTTGTTGGCTGCTCCAGAGGTATCTTTGTCAAAAGC
TTCTGGTTCAATATCAGCCACTGAGCAGATAACCCTGCTTATTTGGTGTGGTTAAATCAACTAGCTTCTGCTAAT
AGCCCCAATTTGCTTGAATGGGAAAACTCTCTCATTTGACCCTTATAGGTAGAAATAATGAATTAACAACCAATA
AAATTAATCATTTGGCATTAAAAAAAAAAAAAAAAAAAAAAAAA
```

FIGURE 378

MATESTPSEIIERERKKLLEILQHDPDSILDTLTSRRLISEEEYETLENVTDLLKKSRKLLILVQKKGEATCQHF
LKCLFSTFPQSAAICGLRHEVLKHENTVPPQSMGASSNSEDAFSPGIKQPEAPEITVFFSEKEHLDLETSEFFRD
KKTSYRETALSARKNEKEYDTPEVTLSYSVEKVGCEVPATITYIKDGQRYEELDDSLYLGKEEYLGSVDTPEDAE
ATVEEEVYDDPEHVGYDGEEDFENSETTEFSGEEPSYEGSETSLSLEEEQEKSIEERKKVFKDVLLCLNMDRSRK
VLPDFVKQFSLDRGCKWTPESPGDLAWNFLMKVQARDVTARDSILSHKVLDEDSKEDLLAGVENLEIRDIQTINP
LDVLCATMLCSDSSLQRQVMSNMYQCQFALPLLLPDAENNKSILMLGAMKDIVKKQSTQFSGGPTEDTEKFLTLM
KMPVISFVRLGYCSFSKSRILNTLLSPAQLKLHKIFLHQDLPLLVLPRQISDGLVEITWCFPDSDDRKENPFFQK
PVALANLRGNLESFWTQFGFLMEVSSAVFFFTDCLGEKEWDLLMFLGEAAIERCYFVLSSQARESEEAQIFQRIL
NLKPAQLLFWERGDAGDRRKNMEGLQAALQEVMFSSCLRCVSVEDMAALARELGIQVDEDFENTQRIQVSSGENM
AGTAEGEGQQRHSQLKSSSKSQALMPIQEPGTQCELSQNLQNLYGTPVFRPVLENSWLFPTRIGGNFNHVSLKAS
WVMGRPFGSEQRPKWFHPLPFQNAGAQGRGKSFGIQSFHPQIFYSGERFMKFSRVARGCHSNGTFGRLPRPICQH
VQACPERPQMMGTLERSRAVASKIGHSYSLDSQPARAVGKPWPQQACTRVTELTEATGKLIRTSHIGKPHPQSFQ
PAAATQKLRPASQQGVQMKTQGGASNPALQIGSHPMCKSSQFKSDQSNPSTVKHSQPKPFHSVPSQPKSSQTKSC
QSQPSQTKPSPCKSTQPKPSQPWPPQSKPSQPRPPQPKSSSTNPSQAKAHHSKAGQKRGGKH

FIGURE 379

CAATACAGCTAAGGAATTATCCCTTGTAAATACCACAGACCCGCCCTGGAGCCAGGCCAAGCTGGACTGCATAAA
GATTGGTATGGCCTTAGCTCTTAGCCAAACACCTTCCTGACACCATGAGGGCCAGCAGCTTCTTGATCGTGGTGG
TGTTCCTCATCGCTGGGACGCTGGTTCTAGAGGCAGCTGTCACGGGAGTTCCTGTTAAAGGTCAAGACACTGTCA
AAGGCCGTGTTCCATTCAATGGACAAGATCCCGTTAAAGGACAAGTTTCAGTTAAAGGTCAAGATAAAGTCAAAG
CGCAAGAGCCAGTCAAAGGTCCAGTCTCCACTAAGCCTGGCTCCTGCCCCATTATCTTGATCCGGTGCGCCATGT
TGAATCCCCCTAACCGCTGCTTGAAAGATACTGACTGCCCAGGAATCAAGAAGTGCTGTGAAGGCTCTTGCGGGA
TGGCCTGTTTCGTTCCCCAGTGAAGGGAGCCGGTCCTTGCTGCACCTGTGCCGTCCCCAGAGCTACAGGCCCCAT
CTGGTCCTAAGTCCCTGCTGCCCTTCCCCTTCCCACACTGTCCATTCTTCCTCCCATTCAGGATGCCCACGGCTG
GAGCTGCCTCTCTCATCCACTTTCCAATAAA

FIGURE 380

MRASSFLIVVVFLIAGTLVLEAAVTGVPVKGQDTVKGRVPFNGQDPVKGQVSVKGQDKVKAQEPVKGPVSTKPGS
CPIILIRCAMLNPPNRCLKDTDCPGIKKCCEGSCGMACFVPQ

FIGURE 381

```
AGCTTCCAGCACAGCCCGCGGCCCGGTGCCAGCTCCGCCGGCGACCGGTGTGCCAAAGTGCGGTGCTCCCGCAGG
GAACCTGGCTCGGGGAGGGCCTCCAGGTGAGTGCCGGGCTCGGCGCTCTGCTCCTGGAGCTCCCGCGGGACTGCC
TGGGGACAGGGACTGCTGTGGCGCTCGGCCCTCCACTGCGGACCTCTCCTGAGTGGGTGCGCCGAGTCATGGAGG
GCGCAGAGCTGGCCGGGAAGATCCTTTCCACCTGGCTGACGCTGGTTCTCGGCTTCATCCTTTTACCTTCGGTCT
TCGGAGTGTCTCTGGGCATCTCCGAGATCTACATGAAGATCCTAGTGAAAACTTTAGAGTGGGCCACAATACGAA
TTGAAAAAGGAACCCCAAAGGAGTCGATTCTTAAAAACTCTGCTTCTGTTGGTATTATCCAAAGAGATGAGTCAC
CCATGGAAAAAGGGCTCTCTGGTCTACGAGGAAGGGACTTTGAGCTGTCTGACGTGTTTATTTCTCCAAGAAGG
GATTGGAAGCCATTGTAGAAGATGAAGTGACCCAGAGGTTTTCCTCAGAGGAGCTAGTGTCATGGAATCTCCTCA
CAAGAACCAATGTAAATTTCCAGTACATCAGTCTGCGGCTCACTATGGTGTGGGTGCTGGGCGTCATAGTGCGCT
ATTGTGTCCTACTGCCTCTGAGGGTTACCTTGGCTTTCATTGGGATCAGTTTGCTGGTTATAGGAACTACACTGG
TTGGGCAGCTGCCAGACAGCAGCCTCAAAAACTGGCTGAGTGAACTGGTCCATCTGACTTGCTGCCGGATCTGTG
TGCGAGCCCTCTCTGGTACCATTCATTATCATAACAAGCAATACAGACCCCAGAAGGGAGGCATTTGTGTTGCCA
ACCATACTTCCCCCATTGATGTTTTAATCTTGACAACGGATGGATGTTATGCTATGGTTGGCCAGGTTCATGGCG
GCTTGATGGGAATTATTCAGAGAGCTATGGTCAAGGCTTGTCCTCATGTCTGGTTTGAACGCTCAGAAATGAAGG
ATCGACACCTGGTTACTAAGAGACTAAAAGAACATATTGCTGATAAGAAGAAACTACCCATACTAATTTTTCCTG
AAGGAACTTGCATCAACAATACTTCAGTCATGATGTTTAAAAAGGGGAGCTTTGAAATTGGAGGAACCATACATC
CAGTTGCAATTAAGTATAACCCTCAGTTCGGTGATGCATTTTGGAACAGTAGTAAATACAACATGGTGAGCTACC
TGCTTCGAATGATGACCAGCTGGGCCATCGTCTGTGACGTGTGGTACATGCCCCCCATGACCAGAGAGGAAGGAG
AAGATGCAGTCCAGTTTGCTAACAGGGTTAAGTCTGCTATTGCTATACAAGGAGGCCTGACTGAACTTCCCTGGG
ATGGAGGACTAAAGAGAGCAAAGGTGAAGGACATCTTTAAGGAAGAGCAGCAGAAAATTACAGCAAGATGATTG
TGGGCAATGGATCTCTCAGCTAAGAGGACGGATGACAGCCTTTAGATCTAGAACTAGCCCTTAGAAATGGAATGG
CTTTTTTGTTTTGTTTGTTTTATTGTTTGTTTTATTATTGTTAATCTTTTCTACAGAATGATTGTCTCTAC
CTCTTTATGCCAGAGGCAGAACCTACAGGTGCCCTTTTTGGCTTTGTTGTTGTTGTAACATTAGCCCCATGGAT
TGTAAGGTGGTTTACTGAGTTAAAACAGATTCTGCTTTTGTAAAATGATGGCATCACTGTGGACTGAATGAAATA
TTTGTATAGAAAAAAGTGCTTGAAAAGTGTGTTTGGAACTCATCGATAGGGTAATTCTCCAAAAATGCCCAAACT
CTTTTTCTGTAATTAGCCTTGCCACTTTCTTCAGTCACTTAAATGGTGAGATTACACATCAGTGCAAGATGACCA
TTATGGTTATGGTCTACTGCAAGGTTGAAAGGAAAAATGGAGGATTGTATTTAGGAAAAGGGACAACTTTGTGGC
CACCTGCTCTGAAAGTCAAAAGGAAATGTAAATTAGTGTCATTAGTGTGTTGGAAGAGAAATACTATTCAGTAAG
CTTCGCCAAAGAAAAGTGAGTCAAAGTTAATGTGTGTGCGCATTTATATGTAGGCAGCTCGTAGACCACATTTTA
ACCAGCAACTGGTAACAAAGAGCTTAGTTTTCCTTGTTTGAATGCTGTAGATCTGTACCTAGTACCCCTCCCATC
TACTGATTTGTTTGTTTTTGTAACCAAACACATTTTCAGATAGAAGGAGCCTT
```

FIGURE 382

MEGAELAGKILSTWLTLVLGFILLPSVFGVSLGISEIYMKILVKTLEWATIRIEKGTPKESILKNSASVGIIQRD
ESPMEKGLSGLRGRDFELSDVFYFSKKGLEAIVEDEVTQRFSSEELVSWNLLTRTNVNFQYISLRLTMVWVLGVI
VRYCVLLPLRVTLAFIGISLLVIGTTLVGQLPDSSLKNWLSELVHLTCCRICVRALSGTIHYHNKQYRPQKGGIC
VANHTSPIDVLILTTDGCYAMVGQVHGGLMGIIQRAMVKACPHVWFERSEMKDRHLVTKRLKEHIADKKKLPILI
FPEGTCINNTSVMMFKKGSFEIGGTIHPVAIKYNPQFGDAFWNSSKYNMVSYLLRMMTSWAIVCDVWYMPPMTRE
EGEDAVQFANRVKSAIAIQGGLTELPWDGGLKRAKVKDIFKEEQQKNYSKMIVGNGSLS

FIGURE 383

AAAAAAATGAAATAGTTGAAAAACTCTGGGGTGTAAACAAATGATTGTAACCCTACACACTATTCAATAAGTAGT
AGAAGGAGCATCACACAGATTTCAGTCTAATCTGCCCTTCTGTGGGCCATAATATAAACATAAATGTGTGTAATG
ATAAAAAGTCATTTTCTTCAAAGAGACTACAGCTAGCTGCACATTGTGTAGAGCAGCTTCTAAATTGTTAGACTT
TGTGTTGAAATGTAATATTCTATTTATTGAGAAAGTGATTTAAAATTATTATTTTTAATCATAGAAATCAGGGTT
TGGGCTGTATTGATATTGTCGATCATGAAATGTCCACACTTATTCTAAGTGGCCAATTATTTGGAAATAAAGAAG
GAAATAAAGATGGCTTCACATGGAAATTTAAGTTCTTTCAGGGTGGAGATTTACTTGGTTCATACACCTTTTGCC
TGAATTAAAGTATTTCATGTAGGAGGACTTTTATCCTTTTGATAGACAGTTTCATATATCTTGAACTCAATATC
TCAGATCTCTTCTACTGTATTACTGAATAGCATACATACATAGACAATGTTCGCCATTCACTAGATATTTTTTC
TATTATCTTACACTTATTCAAGCTTGTCTGTGATTAATGGAATTGGTGTCAGATGCTGGAATTTATTCTGACCAA
TGAACACAGCTGACTCAGGGGAGTACAATCTCCTGCCAAGTAATAGAACCAAACCCAATATGCATAAAAGAAATA
CAATACTCCAGGCTTTAGCTGAAGGAAGCAACTACCTGTGTAATAACAAAGCAGCAAAAACTATTTCTCATGTGG
CTGCATAGGCTGTATATTATATCTGATCTCTAATGTAGCTTACTGGTTTGCCTTTTTTAAAACCAAAATTGGAAA
TTTTCCTTTGTAAAGAAAAAAAGTCTTATGAGATAATTGCTTGATTAATGTTTTGAACAATACCAAGAAATTGTT
TAATTAAAATAAATATTTTTGTTTGAAATTGAAGTGGATGTGAAATATTGTCCTTGCCTATAGATCTCAAAATCT
AGTACTAATTGTTGGTTGTTAATATGATTCATACAATAGACATTTGTTAAACCAGCTTTTGAGTGGAGAAAATTA
TTTTCCATTTAAACAGTACAGTGATGATAGCTATCAAACAGGTATACTAAAAAGTCAGTGACTGTGACAGTTTAA
AGTGTTAGACAAATGATGTATAAGGTTCTTTAGTAAGGAAAGATTAGCCAAAAATTTTTTACCCAGCTAGAAGCT
TTTAAATCTACACTTGATATCTCTGTTCTAGGTAAAATTCAAACAACCAAAAAACAGTGGCCCATCTGTAGCTTA
TGAATCTATTTAAAATTGAATATTTTATGTTGACTTCTTTCATACTAGCTGAAACTTGCTCTAAAGAGCTTCCTT
TGGAATCTTTAGATTTCTTTTTATAAGGTTCAATTCAGTACATCCATAAATCGACAGAATGAAGAAAACATAACA
AAAAGCCACCTATTCCTTCCTCTTGCTCCCTTATTAGCTAAAGTAAAATTTACATCTGTAAGACTTACTGAGTTG
CTGCCAAAATGGAACTGAATTCTTAAAAGAGGAACATGCCTATGTGAAACATTAGAAAACCAAAATAAATGGGAA
AATTCAGACTTGAAGAGCTGAATCATGTGACAACAAAGTACTGATCTTAATTCAGAAAGGCTACTTGGAGAAGGT
GTATCTTAAGGGGTAAAAAACCTGTGGGTTACCACATATTAACAGGGAATAATATCAACAGAGGCACCCATAAGC
AAGCAAGACACAACTGAGACAGATGTACCAGGTGAAAAAAATCTTCAGTATGGATACACATGGGTATTCTGAAGG
CTACAATGAATGGTTTAGTCTTTGACATAAGGAGGATGAACATATTATTTATACTGTGTAATCTAATCTGGCTTC
TATGGGGAAAGCAACATGTACATAAGTGAATTTTCTACATGAAGTGGGCTACTTCTGATTTAATCAAAGCTATA
AAATAGATTGTATATTTCACTAGCTTCTTAAAGTAACTCTTCCATTTTCATTTATCTCTAAAAACAGTTAACTTC
CTGTGCTCTAGGAAATGCACCAATACCAAAGGTCAATGTGGAAATATGGGCATGTTTGCCCCTATGCTGTGTGGT
CTCTAGATTTCTATATTTGCTTTGCTTTTGTCTGCTCTAGTAATCTCCCTCCTTTTGATCTGTGGCCTGGGAAAA
TGTGGTTTCTTTGTATTTCAAATAAAAGTAAAATAGTTTTTTGAGTGGTTCACTCAAG

FIGURE 384

MHQYQRSMWKYGHVCPYAVWSLDFYICFAFVCSSNLPPFDLWPGKMWELCISNKSKIVFFEWFT

FIGURE 385

AGGACCACGCCTCCTCCAAGTCCCAGCGAACCCGCGTGCAACCTGTCCCGACTCTAGCCGCCTCTTCAGCTCGCC
ATGGATCCCAACTGCTCCTGCGCCGCCGGTGACTCCTGCACCTGCGCCGGCTCCTGCAAATGCAAAGAGTGCAAA
TGCACCTCCTGCAAGAAAAGCTGCTGCTCCTGCTGCCCTGTGGGCTGTGCCAAGTGTGCCCAGGGCTGCATCTGC
AAAGGGGCGTCGGACAAGTGCAGCTGCTGCGCCTGATGCTGGGACAGCCCCGCTCCCAGATGTAAAGAACGCGAC
TTCCACAAACCTGGATTTTTTATGTACAACCCTGACCGTGACCGTTTGCTATATTCCTTTTTCTATGAAATAATG
TGAATGATAATAAAACAGCTTTGACTTGAAAAAAAAAAAAAAAAAAAAAAAAAAAAAAAAAAAAAAAAAAAAAAA
A

FIGURE 386

MDPNCSCAAGDSCTCAGSCKCKECKCTSCKKSCCSCCPVGCAKCAQGCICKGASDKCSCCA

FIGURE 387

CCCATCTTAGAGCAGCTGAATAATTTCCTGAGAATTCTATTCCTGAAGCTAGGAAGAAAAGTTTATTTATACATA
CACGCAACCTGCAAGTCTCCAGTTTCTATTCTTCCTTCCTCTTTGACCCTTCCCCTCCCCCACTTTGCACCAGAG
AAGTCAGACTCCGGGAGTGCTTTAACAGTTTGAAGGCTAATCTGAAAGAGGAAGAAGAATCTGTATATCTGTATA
TATTGGCTAGCAAATGTGCCCTGCTCTCTCCCCTCTTAAAAATAGCAGCAACCCATCTTTGCAAAGAAGCTTGCC
TATAGAGCAGGCACTCTGTGAATGGACTGTGCTTTTACGACCCTACAGGGTATCAAGATACTGTGCAGCTCGCCA
ACAAGGATTAATTGCAAGGACTGGTAGATCGAATTTACTGAAGACTTGGAGCTTGCTTCTGAGAACAAACGCAAA
AGGACAGTAAACTGTGGACCTTGAAGTTAGCAGCGTGGGCTTCCTCTAATATTACACCGTAAAAGGCATTGATCA
CCATAAGAAGGAACATTTGTGAAGGTACTCCAGTGCCAGAAAGAGGCACAAAGCAGACATTCGTAGAGAAACATG
GATGAAACAGGAAATCTGACAGTATCTTCTGCCACATGCCATGACACTATTGATGACTTCCGCAATCAAGTGTAT
TCCACCTTGTACTCTATGATCTCTGTTGTAGGCTTCTTTGGCAATGGCTTTGTGCTCTATGTCCTCATAAAAACC
TATCACAAGAAGTCAGCCTTCCAAGTATACATGATTAATTTAGCAGTAGCAGATCTACTTTGTGTGTGCACACTG
CCTCTCCGTGTGGTCTATTATGTTCACAAAGGCATTTGGCTCTTTGGTGACTTCTTGTGCCGCCTCAGCACCTAT
GCTTTGTATGTCAACCTCTATTGTAGCATCTTCTTTATGACAGCCATGAGCTTTTCCGGTGCATTGCAATTGTT
TTTCCAGTCCAGAACATTAATTTGGTTACACAGAAAAAAGCCAGGTTTGTGTGTAGGTATTTGGATTTTTGTG
ATTTTGACCAGTTCTCCATTTCTAATGGCCAAACCACAAAAAGATGAGAAAAATAATACCAAGTGCTTTGAGCCC
CCACAAGACAATCAAACTAAAAATCATGTTTTGGTCTTGCATTATGTGTCATTGTTTGTTGGCTTTATCATCCCT
TTTGTTATTATAATTGTCTGTTACACAATGATCATTTTGACCTTACTAAAAAAATCAATGAAAAAAAATCTGTCA
AGTCATAAAAAGGCTATAGGAATGATCATGGTCGTGACCGCTGCCTTTTAGTCAGTTTCATGCCATATCATATT
CAACGTACCATTCACCTTCATTTTTTACACAATGAAACTAAACCCTGTGATTCTGTCCTTAGAATGCAGAAGTCC
GTGGTCATAACCTTGTCTCTGGCTGCATCCAATTGTTGCTTTGACCCTCTCCTATATTTCTTTTCTGGGGGTAAC
TTTAGGAAAAGGCTGTCTACATTTAGAAAGCATTCTTTGTCCAGCGTGACTTATGTACCCAGAAAGAAGGCCTCT
TTGCCAGAAAAAGGAGAAGAAATATGTAAAGTATAGTTAAACCCATTTCCAGTCCAAACCAATGAAAATAGTTT
CCCAAATAAGTATTTTGTCAAATCATTTACAAAAAAAATAAAAATTTTACTTAATATTTTACAAATACTTAACTA
TTTGGGCCTACAACTCTATCTCATTTATGCATCCACATGATTAGATATTTATAGATATTTAAGTGCTAAAAATT
CGGTCCACAACTATGAACTGAATTATAAATAATTTTGACCACTCACCAGAATTTGGAGAATATTTTTATCTTTGC
ACTATAAAATATGTCTTATATTAAAGTTTTCCTCTTCAAATAAAAGCTTTACAAACGATAAAATATATAAAATTA
GTCAATAAAAATACATGCAAGCTAAAAGTTATAAAATATAAAACTAGATATAAAATTGGCAAATAGTTCTGAATC
ATTCTAACATATTCCTTTGCATGCATGCCATCAGATGAGAACTGGAGATGACTCAGGAGCTACATAAAACGTACT
GTCACCCTTCTTTGTAGTACTGATTCGCTAGGCAAATTAGGGCCATTCTTCCAAAAGAGAATGTAAAAGTGCTA
GAACAGACTAGTATTCAGCTAAAGGGTCCTAAAAGCACCATACAATGTTCAATATGGCAACAGGAGAAATCTGGT
CAAAAGCCAGTTTGTCTCCAGTTTTCTTCTGCCTTTGCCTCAGGCTCCCAAAATTGAATAGTGGAGTTTTAGCTG
CTCAGTGAGGTTCCTGTAGAGATTTCTCTCCATCCATGACATACAATTCTTCCTTAAGAAGCCAGACAACTGGCA
CTCCTATATATAAATAGAAGTAATTAAAAACTTATCTGAAGAAGAGAAAAGGAAAAGGAATCTACTTTTCTATAT
GCCAATTGCTGGGATCAAAATAAACTACAAAGGATTTATGAAGAAAATTGTGAATGTTCACGTTACAAATTCTTT
TAAGAAGTGCATACATTTATGTATATGTATACAACTATATGTAAGAGATTTGCTGTATGATATGCATTATGGGT
GAAAGTTCACGATAAGTTTTATTATTGCTTTATTACTTTTTATTGGTATGTTGACAGGAATATCATGGATATGTT
TACAGTGACTTTTATATTACAGTGGACGCTTTGATCTTAAAACAGCCACAACAACTCATCTACGGCTGAAATATA
ATATGCGTGGACAAGCTTTTGCTGAAGTGTAGTGTGTCCTTTAAGTTTGTTTTTAAAAAGTAACTTACCTCAGA
AGAAATAAATGATAACTATAAAGAAA

FIGURE 388

MISVVGFFGNGFVLYVLIKTYHKKSAFQVYMINLAVADLLCVCTLPLRVVYYVHKGIWLFGDFLCRLSTYALYVN
LYCSIFFMTAMSFFRCIAIVFPVQNINLVTQKKARFVCVGIWIFVILTSSPFLMAKPQKDEKNNTKCFEPPQDNQ
TKNHVLVLHYVSLFVGFIIPFVIIIVCYTMIILTLLKKSMKKNLSSHKKAIGMIMVVTAAFLVSFMPYHIQRTIH
LHFLHNETKPCDSVLRMQKSVVITLSLAASNCCFDPLLYFFSGGNFRKRLSTFRKHSLSSVTYVPRKKASLPEKG
EEICKV

FIGURE 389

```
ACCCCTCACTAAAGGGAACAAAAGCTGGAGCTCAAGGATCCTTAATTAAATTAATCCCCCCCCCCCCCGGNATG
CGCGTTGCGCGCCGGACGCGGAACGTCTGCCGGTGTCCCCGCGCTGCTGGTCCCGGGGTCCCTGAACCGCGGCG
GCCCCGCTCCCTCTGCTGGCCATGGCCCCCCCGCCCGCGTGCCGGTCCCCGATGTCACCGCCGCCGCCGCTGCTG
CTGCTGCTGCTGAGTCTGGCGCTGCTGGGCGCCCGGGCCCGCGCCGAGCCCGCCGGGAGTGCCGTCCCCGCG
CAGAGCCGCCCATGCGTGGACTGCCACGCCTTCGAGTTCATGCAGCGCGCCCTGCAGGACCTGCGGAAGACAGCC
TGCAGCCTGGACGCGCGGACGGAGACCCTACTGCTGCAGGCAGAGCGCCGTGCCCTGTGTGCCTGCTGGCCAGCG
GGGCACTGAGGACCACGCTGCTCCGTGTGAATAAATGCCCAGTGGCAAAAAAAAAAAAAAAAAAAAAA
```

FIGURE 390A

```
GCCGCGTGCGTCCTGCCCGGAGCCGGCGGGACATGCCCGGAGCGCGCGCTGGAGCGGCGCGAGGAGGAGGCGAAC
GTGGTGCTCACCGGGACGGTGGAGGAGATCCTCAACGTGGACCCGGTGCAGCACACGTACTCCTGCAAGGTTCGG
GTCTGGCGGTACTTGAAGGGCAAAGACCTGGTGGCCCGGGAGAGCCTGCTGGACGGCGGCAACAAGGTGGTGATC
AGCGGCTTTGGAGACCCCCTCATCTGTGACAACCAGGTGTCCACTGGGGACACCAGGATCTTCTTTGTGAACCCT
GCACCCCCATACCTGTGGCCAGCCCACAAGAACGAGCTGATGCTCAACTCCAGCCTCATGCGGATCACCCTGCGG
AACCTGGAGGAGGTGGAGTTCTGTGTGGAAGATAAACCCGGGACCCACTTCACTCCAGTGCCTCCGACGCCTCCT
GATGCGTGCCGGGGAATGCTGTGCGGCTTCGGCGCCGTGTGCGAGCCCAACGCGGAGGGGCCGGGCCGGGCGTCC
TGCGTCTGCAAGAAGAGCCCGTGCCCCAGCGTGGTGGCGCCTGTGTGGGTCGGACGCCTCCACCTACAGCAAC
GAATGCGAGCTGCAGCGGGCGCAGTGCAGCCAGCAGCGCCGCATCCGCCTGCTCAGCCGCGGGCCGTGCGGCTCG
CGGGACCCCTGCTCCAACGTGACCTGCAGCTTCGGCAGCACCTGTGCGCGCTCGGCCGACGGGCTGACGGCCTCG
TGCCTGTGCCCCGCGACCTGCCGTGGCGCCCCGAGGGGACCGTCTGCGGCAGCGACGGCGCCGACTACCCCGGC
GAGTGCCAGCTCCTGCGCCGCGCCTGCGCCCGCCAGGAGAATGTCTTCAAGAAGTTCGACGGCCCTTGTGACCCC
TGTCAGGGCGCCCTCCCTGACCCGAGCCGCAGCTGCCGTGTGAACCCGCGCACGCGGCGCCCTGAGATGCGCCTA
CGGCCCGAGAGCTGCCCTGCCCGGCAGGCGCCAGTGTGTGGGGACGACGGAGTCACCTACGAAAACGACTGTGTC
ATGGGCCGATCGGGGGCCGCCCGGGGTCTCCTCCTGCAGAAAGTGCGCTCCGGCCAGTGCCAGGGTCGAGACCAG
TGCCCGGAGCCCTGCCGGTTCAATGCCGTGTGCCTGTCCCGCCGTGGCCGTCCCCGCTGCTCCTGCGACCGCGTC
ACCTGTGACGGGGCCTACAGGCCCGTGTGTGCCCAGGACGGGCGCACGTATGACAGTGATTGCTGGCGGCAGCAG
GCTGAGTGCCGGCAGCAGCGTGCCATCCCCAGCAAGCACCAGGGCCCGTGTGACCAGGCCCCGTCCCCATGCCTC
GGGGTGCAGTGTGCATTTGGGGCGACGTGTGCTGTGAAGAACGGGCAGGCAGCGTGTGAATGCCTGCAGGCGTGC
TCGAGCCTCTACGATCCTGTGTGCGGCAGCGACGGCGTCACATACGGCAGCGCGTGCGAGCTGGAGGCCACGGCC
TGTACCCTCGGGCGGGAGATCCAGGTGGCGCGCAAAGGACCCTGTGACCGCTGCGGGCAGTGCCGCTTTGGAGCC
CTGTGCGAGGCCGAGACCGGGCGCTGCGTGTGCCCCTCTGAATGCGTGGCTTTGGCCCAGCCCGTGTGTGGCTCC
GACGGGCACACGTACCCCAGCGAGTGCATGCTGCACGTGCACGCCTGCACACACCAGATCAGCCTGCACGTGGCC
TCAGCTGGACCCTGCGAGACCTGTGGAGATGCCGTGTGTGCTTTTGGGGCTGTGTGCTCCGCAGGGCAGTGTGTG
TGTCCCCGGTGTGAGCACCCCCGCCCGGCCCCGTGTGTGGCAGCGACGGTGTCACCTACGGCAGTGCCTGCGAG
CTACGGGAAGCCGCCTGCCTCCAGCAGACACAGATCGAGGAGGCCCGGGCAGGGCCGTGCGAGCAGGCCGAGTGC
GGTTCCGGAGGCTCTGGCTCTGGGGAGGACGGTGACTGTGAGCAGGAGCTGTGCCGGCAGCGCGGTGGCATCTGG
GACGAGGACTCGGAGGACGGGCCGTGTGTCTGTGACTTCAGCTGCCAGAGTGTCCCAGGCAGCCCGGTGTGCGGC
TCAGATGGGGTCACCTACAGCACCGAGTGTGAGCTGAAGAAGGCCAGGTGTGAGTCACAGCGAGGGCTCTACGTA
GCGGCCCAGGGAGCCTGCCGAGGCCCCACCTTCGCCCCGCTGCCGCCTGTGGCCCCCTTACACTGTGCCCAGACG
CCCTACGGCTGCTGCCAGGACAATATCACCGCAGCCCGGGGCGTGGGCCTGGCTGGCTGCCCCAGTGCCTGCCAG
TGCAACCCCCATGGCTCTTACGGCGGCACCTGTGACCCAGCCACAGGCCAGTGCTCCTGCCGCCCAGGTGTGGGG
GGCCTCAGGTGTGACCGCTGTGAGCCTGGCTTCTGGAACTTTCGAGGCATCGTCACCGATGGCCGGAGTGGCTGT
ACACCCTGCAGCTGTGATCCCCAAGGCGCCGTGCGGGATGACTGTGAGCAGATGACGGGGCTGTGCTCGTGTAAG
CCCGGGGTGGCTGGACCCAAGTGTGGGCAGTGTCCAGACGGCCGTGCCCTGGGCCCCGCGGGCTGTGAAGCTGAC
GCTTCTGCGCCTGCGACCTGTGCGGAGATGCGCTGTGAGTTCGGTGCGCGGTGCGTGGAGGAGTCTGGCTCAGCC
CACTGTGTCTGCCCGATGCTCACCTGTCCAGAGGCCAACGCTACCAAGGTCTGTGGGTCAGATGGAGTCACATAC
GGCAACGAGTGTCAGCTGAAGACCATCGCCTGCCGCCAGGGCCTGCAAATCTCTATCCAGAGCCTGGGCCCGTGC
CAGGAGGCTGTTGCTCCCAGCACTCACCCGACATCTGCCTCCGTGACTGTGACCACCCCAGGGCTCCTCCTGAGC
CAGGCACTGCCGGCCCCCCCGGCGCCCTCCCCCTGGCTCCCAGCAGTACCGCACACAGCCAGACCACCCCTCCG
CCCTCATCGCGACCTCGGACCACTGCCAGCGTCCCCAGGACCACCGTGTGGCCCGTGCTGACGGTGCCCCCACG
GCACCCTCCCCTGCACCCAGCCTGGTGGCGTCCGCCTTTGGTGAATCTGGCAGCACTGATGGAAGCAGCGATGAG
GAACTGAGCGGGGACCAGGAGGCCAGTGGGGGTGGCTCTGGGGGGCTCGAGCCCTTGGAGGGCAGCAGCGTGGCC
ACCCCTGGGCCACCTGTCGAGAGGGCTTCCTGCTACAACTCCGCGTTGGGCTGCTGCTCTGATGGGAAGACGCCC
TCGCTGGACGCAGAGGGCTCCAACTGCCCCGCCACCAAGGTGTTCCAGGGCGTCCTGGAGCTGGAGGGCGTCGAG
GGCCAGGAGCTGTTCTACACGCCCGAGATGGCTGACCCCAAGTCAGAACTGTTCGGGGAGACAGCCAGGAGCATT
GAGAGCACCCTGGACGACCTCTTCCGGAATTCAGACGTCAAGAAGGATTTCCGGAGTGTCCGCTTGCGGGACCTG
GGGCCCGGCAAATCCGTCCGCGCCATTGTGGATGTGCACTTTGACCCCACCACAGCCTTCAGGGCACCCGACGTG
```

FIGURE 390B

```
GCCCGGGCCCTGCTCCGGCAGATCCAGGTGTCCAGGCGCCGGTCCTTGGGGGTGAGGCGGCCGCTGCAGGAGCAC
GTGCGATTTATGGACTTTGACTGGTTTCCTGCGTTTATCACGGGGGCCACGTCAGGAGCCATTGCTGCGGGAGCC
ACGGCCAGAGCCACCACTGCATCGCGCCTGCCGTCCTCTGCTGTGACCCCTCGGGCCCCGCACCCCAGTCACACA
AGCCAGCCCGTTGCCAAGACCACGGCAGCCCCCACCACACGTCGGCCCCCCACCACTGCCCCCAGCCGTGTGCCC
GGACGTCGGCCCCCGGCCCCCCAGCAGCCTCCAAAGCCCTGTGACTCACAGCCCTGCTTCCACGGGGGGACCTGC
CAGGACTGGGCATTGGGCGGGGGCTTCACCTGCAGCTGCCCGGCAGGCAGGGGAGGCGCCGTCTGTGAGAAGGTG
CTTGGCGCCCCTGTGCCGGCCTTCGAGGGCCGCTCCTTCCTGGCCTTCCCCACCCTCCGCGCCTACCACACGCTG
CGCCTGGCACTGGAATTCCGGGCGCTGGAGCCTCAGGGGCTGCTGCTGTACAATGGCAACGCCCGGGGCAAGGAC
TTCCTGGCATTGGCGCTGCTAGATGGCCGCGTGCAGCTCAGGTTTGACACAGGTTCGGGGCCGGCGGTGCTGACC
AGTGCCGTGCCGGTAGAGCCGGGCCAGTGGCACCGCCTGGAGCTGTCCCGGCACTGGCGCCGGGGCACCCTCTCG
GTGGATGGTGAGACCCCTGTTCTGGGCGAGAGTCCCAGTGGCACCGACGGCCTCAACCTGGACACAGACCTCTTT
GTGGGCGGCGTACCCGAGGACCAGGCTGCCGTGGCGCTGGAGCGGACCTTCGTGGGCGCCGGCCTGAGGGGGTGC
ATCCGTTTGCTGGACGTCAACAACCAGCGCCTGGAGCTTGGCATTGGGCCGGGGCTGCCACCCGAGGCTCTGGC
GTGGGCGAGTGCGGGGACCACCCCTGCCTGCCCAACCCCTGCCATGGCGGGGCCCCATGCCAGAACCTGGAGGCT
GGAAGGTTCCATTGCCAGTGCCCGCCCGGCCGCGTCGGACCAACCTGTGCCGATGAGAAGAGCCCCTGCCAGCCC
AACCCCTGCCATGGGGCGGCGCCCTGCCGTGTGCTGCCCGAGGGTGGTGCTCAGTGCGAGTGCCCCCTGGGGCGT
GAGGGCACCTTCTGCCAGACAGCCTCGGGGCAGGACGGCTCTGGGCCCTTCCTGGCTGACTTCAACGGCTTCTCC
CACCTGGAGCTGAGAGGCCTGCACACCTTTGCACGGGACCTGGGGGAGAAGATGGCGCTGGAGGTCGTGTTCCTG
GCACGAGGCCCCAGCGGCCTCCTGCTCTACAACGGGCAGAAGACGGACGGCAAGGGGGACTTCGTGTCGCTGGCA
CTGCGGGACCGCCGCCTGGAGTTCCGCTACGACCTGGGCAAGGGGCAGCGGTCATCAGGAGCAGGGAGCCAGTC
ACCCTGGGAGCCTGGACCAGGGTCTCACTGGAGCGAAACGGCCGCAAGGGTGCCCTGCGTGTGGGCGACGGCCCC
CGTGTGTTGGGGGAGTCCCCGGTTCCGCACACCGTCCTCAACCTGAAGGAGCCGCTCTACGTAGGGGGCGCTCCC
GACTTCAGCAAGCTGGCCCGTGCTGCTGCCGTGTCCTCTGGCTTCGACGGTGCCATCCAGCTGGTCTCCCTCGGA
GGCCGCCAGCTGCTGACCCCGGAGCACGTGCTGCGGCAGGTGGACGTCACGTCCTTTGCAGGTCACCCCTGCACC
CGGGCCTCAGGCCACCCCTGCCTCAATGGGGCCTCCTGCGTCCCGAGGGAGGCTGCCTATGTGTGCCTGTGTCCC
GGGGGATTCTCAGGACCGCACTGCGAGAAGGGGCTGGTGGAGAAGTCAGCGGGGGACGTGGATACCTTGGCCTTT
GACGGGCGGACCTTTGTCGAGTACCTCAACGCTGTGACCGAGAGCGAGAAGGCACTGCAGAGCAACCACTTTGAA
CTGAGCCTGCGCACTGAGGCCACGCAGGGGCTGGTGCTCTGGAGTGGCAAGGCCACGGAGCGGGCAGACTATGTG
GCACTGGCCATTGTGGACGGGCACCTGCAACTGAGCTACAACCTGGGCTCCCAGCCCGTGGTGCTGCGTTCCACC
GTGCCCGTCAACACCAACCGCTGGTTGCGGGTCGTGGCACATAGGGAGCAGAGGGAAGGTTCCCTGCAGGTGGGC
AATGAGGCCCCTGTGACCGGCTCCTCCCCGCTGGGCGCCACGCAGCTGGACACTGATGGAGCCCTGTGGCTTGGG
GGCCTGCCGGAGCTGCCCGTGGGCCCAGCACTGCCCAAGGCCTACGGCACAGGCTTTGTGGGCTGCTTGCGGGAT
GTGGTGGTGGGCCGGCACCCGCTGCACCTGCTGGAGGACGCCGTCACCAAGCCAGAGCTGCGGCCCTGCCCCACC
CCATGAGCTGGCACCAGAGCCCCGCGCCCGCTGTAATTATTTTCTATTTTTGTAAACTTGTTGCTTTTTGATATG
ATTTTCTTGCCTGAGTGTTGGCCGGAGGGACTGCTGGCCCGGCCTCCCTTCCGTCCAGGCAGCCGTGCTGCAGAC
AGACCTAGTGCTGAGGGATGGACAGGCGAGGTGGCAGCGTGGAGGGCTCGGCGTGGATGGCAGCCTCAGGACACA
CACCCCTGCCTCAAGGTGCTGAGCCCCGCCTTGCACTGCGCCTGCCCCACGGTGTCCCCGCCGGGAAGCAGCCC
CGGCTCCTGAATCACCCTCGCTCCGTCAGGCGGGACTCGTGTCCCAAAAAGGAAGGGGCTGCTGAGGTCTGATGG
GGCCCTTCCTCCGGGTGACCCCACAGGGCCTTTCCAAGCCCCTATTTGAGCTGCTCCTTCCTGTGTGTGCTCTGG
ACCCTGCCTCGGCCTCCTGCGCCAATACTGTGACTTCCAAACAATGTTACTGCTGGGCACAGCTCTGCGTTGCTC
CCGTGCTGCCTGCGCCAGCCCCAGGCTGCTGAGGAGCAGAGGCCAGACCAGGGCCGATCTGGGTGTCCTGACCCT
CAGCTGGCCCTGCCCAGCCACCCTGGACATGACCGTATCCCTCTGCCACACCCCAGGCCCTGCGAGGGGCTATCG
AGAGGAGCTCACTGTGGGATGGGGTTGACCTCTGCCGCCTGCCTGGGTATCTGGGCCTGGCCATGGCTGTGTTCT
TCATGTGTTGATTTTATTTGACCCCTGGAGTGGTGGGTCTCATCTTTCCCATCTCGCCTGAGAGCGGCTGAGGGC
TGCCTCACTGCAAATCCTCCCCACAGCGTCAGTGAAAGTCGTCCTTGTCTCAGAATGACCAGGGGCCAGCCAGTG
TCTGACCAAGGTCAAGGGGCAGGTGCAGAGGTGGCAGGGATGGCTCCGAAGCCAGAA
```

FIGURE 391

```
AACVLPGAGGTCPERALERREEEANVVLTGTVEEILNVDPVQHTYSCKVRVWRYLKGKDLVARESLLDGGNKVVI
SGFGDPLICDNQVSTGDTRIFFVNPAPPYLWPAHKNELMLNSSLMRITLRNLEEVEFCVEDKPGTHFTPVPPTPP
DACRGMLCGFGAVCEPNAEGPGRASCVCKKSPCPSVVAPVCGSDASTYSNECELQRAQCSQQRRIRLLSRGPCGS
RDPCSNVTCSFGSTCARSADGLTASCLCPATCRGAPEGTVCGSDGADYPGECQLLRRACARQENVFKKFDGPCDP
CQGALPDPSRSCRVNPRTRRPEMRLRPESCPARQAPVCGDDGVTYENDCVMGRSGAARGLLLQKVRSGQCQGRDQ
CPEPCRFNAVCLSRRGRPRCSCDRVTCDGAYRPVCAQDGRTYDSDCWRQQAECRQQRAIPSKHQGPCDQAPSPCL
GVQCAFGATCAVKNGQAACECLQACSSLYDPVCGSDGVTYGSACELEATACTLGREIQVARKGPCDRCGQCRFGA
LCEAETGRCVCPSECVALAQPVCGSDGHTYPSECMLHVHACTHQISLHVASAGPCETCGDAVCAFGAVCSAGQCV
CPRCEHPPPGPVCGSDGVTYGSACELREAACLQQTQIEEARAGPCEQAECGSGGSGSGEDGDCEQELCRQRGGIW
DEDSEDGPCVCDFSCQSVPGSPVCGSDGVTYSTECELKKARCESQRGLYVAAQGACRGPTFAPLPPVAPLHCAQT
PYGCCQDNITAARGVGLAGCPSACQCNPHGSYGGTCDPATGQCSCRPGVGGLRCDRCEPGFWNFRGIVTDGRSGC
TPCSCDPQGAVRDDCEQMTGLCSCKPGVAGPKCGQCPDGRALGPAGCEADASAPATCAEMRCEFGARCVEESGSA
HCVCPMLTCPEANATKVCGSDGVTYGNECQLKTIACRQGLQISIQSLGPCQEAVAPSTHPTSASVTVTTPGLLLS
QALPAPPGALPLAPSSTAHSQTTPPPSSRPRTTASVPRTTVWPVLTVPPTAPSPAPSLVASAFGESGSTDGSSDE
ELSGDQEASGGGSGGLEPLEGSSVATPGPPVERASCYNSALGCCSDGKTPSLDAEGSNCPATKVFQGVLELEGVE
GQELFYTPEMADPKSELFGETARSIESTLDDLFRNSDVKKDFRSVRLRDLGPGKSVRAIVDVHFDPTTAFRAPDV
ARALLRQIQVSRRRSLGVRRPLQEHVRFMDFDWFPAFITGATSGAIAAGATARATTASRLPSSAVTPRAPHPSHT
SQPVAKTTAAPTTRRPPTTAPSRVPGRRPPAPQQPPKPCDSQPCFHGGTCQDWALGGGFTCSCPAGRGGAVCEKV
LGAPVPAFEGRSFLAFPTLRAYHTLRLALEFRALEPQGLLLYNGNARGKDFLALALLDGRVQLRFDTGSGPAVLT
SAVPVEPGQWHRLELSRHWRRGTLSVDGETPVLGESPSGTDGLNLDTDLFVGGVPEDQAAVALERTFVGAGLRGC
IRLLDVNNQRLELGIGPGAATRGSGVGECGDHPCLPNPCHGGAPCQNLEAGRFHCQCPPGRVGPTCADEKSPCQP
NPCHGAAPCRVLPEGGAQCECPLGREGTFCQTASGQDGSGPFLADFNGFSHLELRGLHTFARDLGEKMALEVVFL
ARGPSGLLLYNGQKTDGKGDFVSLALRDRRLEFRYDLGKGAAVIRSREPVTLGAWTRVSLERNGRKGALRVGDGP
RVLGESPVPHTVLNLKEPLYVGGAPDFSKLARAAAVSSGFDGAIQLVSLGGRQLLTPEHVLRQVDVTSFAGHPCT
RASGHPCLNGASCVPREAAYVCLCPGGFSGPHCEKGLVEKSAGDVDTLAFDGRTFVEYLNAVTESEKALQSNHFE
LSLRTEATQGLVLWSGKATERADYVALAIVDGHLQLSYNLGSQPVVLRSTVPVNTNRWLRVVAHREQREGSLQVG
NEAPVTGSSPLGATQLDTDGALWLGGLPELPVGPALPKAYGTGFVGCLRD
```

FIGURE 392

```
CAGAAAATGCCACAGTCCTCACCTCAATAAATGAGAGGACATTGTGGCAGCCAAAGCCACAACTTGGAAGATGGG
GCTGCACCTGCCAACGAAGACGGGAAATGACCCCCCCCCCAGCCTAGTGTGAACCTGCCCCTCGTCCCACGTATA
GAAAAACCTCGAGTCATGGTGAATGAGTGTCTCGGAGTTGCTCGTGTGTGTGTACACCTGCGTGCGTGTGTGTGC
GTGTGTGCGCGTGTGTTCGTGTATGTGCGTGTGTGCGTGCGCGTGTGTGTGCATTTTGCAAAGGGTGGACATTTC
AGTGTATCTCCCAGAAAGGTGATGAATGAATAGGACTGAGAGTCACAGTGAATGTGGCATGCATGCCTGTGTCAT
GTGACATATGTGAGTCTCGGCATGTCACGGTGGGTGGCTGTGTCTGAGCACCTCCAGCAGATGTCACTCTGAGTG
TGGGTGTTGGTGACATGCATTGCACGGGCCTGTCTCCCTGTTTGTGTAAACATACTAGAGTATACTGCGGCGTGT
TTTCTGTCTACCCATGTCATGGTGGGGAGATTTATCTCCGTACATGTGGGTGTCGCCATGTGTGCCCTGTCACT
ATCTGTGGCTGGGTGAACGGCTGTGTCATTATGAGTGTGCCGAGTTATGCCACCCTGTGTGCTCAGGGCACATGC
ACACAGACATTTTATCTCTGCACTCACATTTTTGTGACTTATGAA
```

FIGURE 393

```
GGCACGAGGTGGGCGCGGTAGCGAGCGCCAGCGTGTGCGCCCTGGTGGCGGGGGTGGTGCTGGCTCAGTACATAT
TCACCTTGAAGAGGAAGACGGGGCGGAAGACCAAGATCATCGAGATGATGCCAGAATTCCAGAAAAGTTCAGTTC
GAATCAAGAACCCTACAAGAGTAGAAGAAATTATCTGTGGTCTTATCAAAGGAGGAGCTGCCAAACTTCAGATAA
TAACGGACTTTGATATGACACTCAGTAGATTTTCATATAAAGGGAAAAGATGCCCAACATGTCATAATATCATTG
ACAACTGTAAGCTGGTTACAGATGAATGTAGAAAAAAGTTATTGCAACTAAAGGAAAAATACTACGCTATTGAAG
TTGATCCTGTTCTTACTGTAGAAGAGAAGTACCCTTATATGGTGGAATGGTATACTAAATCACATGGTTTGCTTG
TTCAGCAAGCTTTACCAAAAGCTAAACTTAAAGAAATTGTGGCAGAATCTGACGTTATGCTCAAAGAAGGATATG
AGAATTTCTTTGATAAGCTCCAACAACATAGCATCCCCGTGTTCATATTTTCGGCTGGAATCGGCGATGTACTAG
AGGAAGTTATTCGTCAAGCTGGTGTTTATCATCCCAATGTCAAAGTTGTGTCCAATTTTATGGATTTTGATGAAA
CTGGGGTGCTCAAAGGATTTAAAGGAGAACTAATTCATGTATTTAACAAACATGATGGTGCCTTGAGGAATACAG
AATATTTCAATCAACTAAAAGACAATAGTAACATAATTCTTCTGGGAGACTCCCAAGGAGACTTAAGAATGGCAG
ATGGAGTGGCCAATGTTGAGCACATTCTGAAAATTGGATATCTAAATGATAGAGTGGATGAGCTTTTAGAAAAGT
ACATGGACTCTTATGATATTGTTTTAGTACAAGATGAATCATTAGAAGTAGCCAACTCTATTTTACAGAAGATTC
TATAAACAAGCATTCTCCAAGAAGACCTCTCTCCTGTGGGTGCAATTGAACTGTTCATCCGTTCATCTTGCTGAG
AGACTTATTTATAATATATCCTTACTCTCGAAGTGTTCCCTTTGTATAACTGAAGTATTTCAGATATGGTGAAT
GCATTGACTGGAAGCTCCTTTTCTCCACCTCTCTCAACACACTCCTCACCGTATCTTTTAACCCATTTAAAAAAA
AAAATCTTAAAGCCAAAATTAGAAAAATAACTCCCTACTTTTCCAAAGTGAATTTTGTAGTTTAATGTTATCATG
CAGCTTTTGAGGAGTCTTTTACACTGGGAAAGTTTGTAGAAATTTTAAAATAAGTTTTATGAAATGGTGAAATAA
TATGCATGATTTTAAGTATTGCCATTTTTGTAATTTGGGTTATTATGCTGATGGTATCACCATCTCTTGAAATTG
TGTTAGGTTTGGTTATTTTGTCTGGGGAAAAAATATTTACTGGAAAAGACTAGCAGTTAGTGTTGGAAAAACCTG
GTGGTGTTTACAATGTTGCTAATCATTACAAAACATTCTATATTGAAGCACTGATAATAAATATGAAATGCAAAA
AAAAAAAAAAAAAA
```

FIGURE 394

MMPEFQKSSVRIKNPTRVEEIICGLIKGGAAKLQIITDFDMTLSRFSYKGKRCPTCHNIIDNCKLVTDECRKKLL
QLKEKYYAIEVDPVLTVEEKYPYMVEWYTKSHGLLVQQALPKAKLKEIVAESDVMLKEGYENFFDKLQQHSIPVF
IFSAGIGDVLEEVIRQAGVYHPNVKVVSNFMDFDETGVLKGFKGELIHVFNKHDGALRNTEYFNQLKDNSNIILL
GDSQGDLRMADGVANVEHILKIGYLNDRVDELLEKYMDSYDIVLVQDESLEVANSILQKIL

FIGURE 395A

```
CATTTTCTAGCACACTGCACTGTCGTGTAGACTTGTGGGAAGAACTTTTCCCGTTTTCAAGCTCCACGCTGCATC
ACAGGAAATGACACTGACCAGATTAAGCTACAAATACAAGTCTCGCAGCCAGTCTCAAAGTCTGTAACCCCAATA
ACATTTTTAGGTAAATAAAAATTGTTACTGGGTGGTCTTCCCTTCTCCAGGAAGCAGAGCTGAGGCTGGTAAAG
TTCCTGCCTGAGATTTTGGCCTTGCAAAGGGATCTAGTGAAGCAGTTCCAGAACGTCCAGCAAGTTGAATACAGC
TCCATCAGAGGCTTCCTCAGCAAGCACAGCTCAGATGGGTTGAGGCAGCTGCTTCACAACAGGATCACAGTCTTT
CTGTCCACATGGAACAAACTGAGGAGATCGCTTGAGACGAACGGTGAGATCAACCTACCCAAAGACTACTGCAGC
ACTGACTTGGATCTGGACACTGAGTTTGAGATCCTCTTGCCACGCCGACGGGGCCTGGGCCTCTGTGCTACCGCT
CTCGTCAGCTACTTGATTCGCCTACACAATGAAATTGTCTACGCCGTGGAAAAACTCTCCAAGGAAAACAACAGC
TATTCCGTGGATGCCGCCGAGGTCACTGAACTGCATGTCATCAGTTATGAAGTGGAGCGGGACCTGACTCCACTG
ATTCTCTCCAACTGCCAGTACCAGGTGGAGGAGGGCAGAGAGACCGTGCAGGAGTTCGATCTGGAGAAGATTCAG
CGGCAGATCGTCAGCCGCTTCCTCCAGGGCAAGCCCCGGCTGAGCCTCAAGGGAATACCCACTCTGGTGTACAGA
CACGACTGGAACTATGAACATCTCTTTATGGACATCAAGAACAAAATGGCACAGGTGATCCCGATAAACCTGATC
CTGTGCACGGGGCTTTCTGCCTTCTCAGTGTGTTTCCCTCCGTGTTAGGCCTACTCCAGCCTTGCCCCGGGTGTT
TGCTGTGAGCCCACAGTTTCTGCGGCCTCCCTTACAGAGAGCAAGCAAGACAGCAAATCAGCAAGTTTTCTTGTA
GAGTAAAAGCAGATTGACATCTTGTGGGTTTGATTCTTAGGAATGATGTTGATGCATGGCCATGCCTGCTGAAGC
GGGAAGTCCATGGAACCGATTTGTTCCTGCTCTCCGCATGCGGGTACTGATAGGTAGACCTGTGTGTCTCCATGG
CCTCCAGGAACTGCCTGCACACCGTGCGCCCAAGTGTCAGCTGTTAGAGAGTTGGCCCCCCGCATGTGGCTTGGG
CAGTGAAGGGGCTCGGCTCTCTTACCAGGTGGTGAGATGCCAGAAACCCAGCCCACAGACATCCCTCTCCTGCTT
TTCATTTCCCAGGACTCCCTCCCCAGCTCGGTCATTAGTGCCATCAGTGGACAGCTGCAGTCCTACAGCGATGCC
TGTGAAGTGCTGTCTGTCGTAGAAGTCACTCTGGGGTTTCTGAGCACAGCTGGTGGGGATCCAAACATGCAGCTG
AATGTGTATACTCAAGACATCCTGCAAATGGGTGATCAGACGATTCACGTGTTAAAGGCCTTAAACAGATGCCAG
TTAAAACACACCATTGCCCTCTGGCAGTTCCTGTCTGCTCATAAGTCTGAACAGCTGCTGCGGCTGCACAAGAG
CCATTTGGGGAAATCAGTTCAAGGTACAAAGCGGATCTGAGCCCGGAAAATGCTAAGCTCCTCAGCACATTCCTA
AATCAGACTGGCCTAGACGCCTTCCTGCTAGAGCTGCACGAAATGATAATCTTGAAACTAAAGAACCCCCAAACC
CAAACCGAGGAGCGCTTCCGCCCTCAGTGGAGCCTGAGAGACACTCTCGTAAGTTACATGCAAACTAAAGAAAGT
GAAATTCTTCCTGAAATGGCATCTCAGTTCCCAGAAGAGATACTGCTCGCCAGCTGTGTCTCAGTGTGGAAAACA
GCTGCTGTGCTGAAATGGAATCGAGAAATGAGATAGAATTATTTCCTCAGCTATCTTTGGATGACTTTGGAGAGA
AGACTCCTCTCTCCTCGTCTGCGGCGTGGACTTGATCATGGACTGGTGCCTTTGCATTCAGAAGGAGAGCTGTCA
GCGTAGCACCGAATTCAAGACCAAGGCGTGCTACCTGAGCTGACAGCTTTTTGAAAGCCGAGCTGTTTCTGAACC
ATGTACATACATGTTCTGAAACTTTCTCATCATTTTATGAGTACTGTTCATTGAGAGATGACAATGAAGATTAGA
TGAAATTGGAAATAAACCAACATTGTTTACATTCCAGGAGACTTGTAGCTCAGCCACACACGCAGTAATGACCTG
TGCCCGTTCGCCTCTGGCACTGCCCACCCCTCTTTTTTTTTCTTCTAATTCTGTACTCACAAAAGAGAATCTC
ATTTTCTTCTTTCTTCCATTCCCTTAAATTCTGAGTACTGTACATATATTTCTGGGTTCCCACGATGATGTGAAA
AACTACCAGACTGTTTTTTGTCTTCTCACAAAGACAAGAAAAATCAGGGCATTTTGTGAGTGCCTTAAGATCAAA
CTAACAAGATCTGACCCTCTCCCCTCACAGTGAGCCACTGCCCCACTTCAGAGGGTAAGAGCCAAAAGCCTCATT
GTGAAAGGCACTGGACTTGGACCAGGGACACCATCAGGGCCTTGGTTTTCTCACGCATAAAATGGAGAGTGGATT
AATCGCCAAAGATTCTTCTGATCTGACATTTTGAAATTGTGAGAGAAACTAGATGACTGTAAACTTGGTCACAGG
CCTGGTTCTGGCAGTTCTTTGCGGACTTTTTTCTAGCATTATGCCAAATAAACATGCAGTCTCAGTGTGCTCTCG
CATGTATGAATATCTAGTCCTTTCTGTGGTTCTCAGCCAAGACATAAAAACTAGGACTCAGAGCACATACAAAAC
CAGTTATGTTTCGGAAAGAGGGAAAAGAGTCCCCGAGCCCGGATCTTGTGCTGCTTTTCTCACTGACGTGTTGCC
TTTTTTCTTTACAAAATCTGCTTTGATACTTAGGACCTCTCTGGACTAATTTCTCTTCCTAGACAGCTCAGCACA
GCTATTGATATGTTAGAGGCAGTATCCTTAATATTCATTCTAAATGAGTTAACGACTTAACTTGAAATTGGGCCT
AAGGAGTGAGAACTACAAAAATACAAAATGCTTGTCCAGGACTCAGCCATGCACACCTTGAGCAGCGCCGGCAGG
AGGCACGGAAGGAACTGTGCTCCGTTCTCCTCACTGTCATGGTGCCACCAGTGTCTGATGAAGGGCAGAGTGACC
CAGACTGCAGGCAGTAACTGACTTCACACAGTCCCTGGCATTTAGTCATCTGTGATTGTTTATCACTCTGGACT
GTGCAGAGCCACCTGCCACCGAGATCTGCATTCCGACTGCCTATGAACGGGTGTGGGGGCCGGGGCTGGCTTGC
TGAAGTCTTCAACTTGCACTCGGAGCTCCTTTGATACCTCAGAGCTGGCTGTCAGGTGGCAGCTCACACCCAGAC
TCACTGGCCACACCTCAGCAGGGGGGAGTCGAGTGTCAGTCTCTTTCTGTGAAGGCTTTTTTTTCCTTTGGCC
```

FIGURE 395B

```
TGGGAATTTTTCCCATTTTTATGAAGGGGTTTTAAATTGTTTCATTTTGTGTGCTGTGCTTCAAAGCCTTAACTG
TCAAATCTTGCATTATCTTGTTTGTACAGAAATATACTGGCCTAGCAGAGGCAAAAAAAAAAAAATGAATTTTAT
TTTACTTGTCACACCTGTCTTAATAAACTGGAGTTTTGCTGCTAAAGAACTCTTCTCTCTGGGGGCAGAGCTTCT
ATTTATGGCACATAGACATCAGCTAGGCTTTTGGGAATCGTTTGTGTTCTTTGTGGAAATGTCCTTTAGAAGCAC
CCATGAAGTAGTGTGTTCAGACTGTGCACACAGAAAACAGGCTCTGCCTTCACATGTGAGACGGTGGACTTTCC
TCTGGACAAAATGACAGCATCCTGGCGACTCCACAGTGGAGCTGAGCGCCACTCCCTGTAGCCGATCTGGGACTG
AAACGCTTACACCTCTGCCTCAGAAGGAGTCCCCCATGCCCTGCCTGAAATGACTTCACTGGACACAGCGGGGCT
GCAGCTAACGGGGTACAGGTAGGAGCTAACTAACTTCACCCCTGAGTCCACTTGCGGGGTAAGAGATAAACAGTA
ACCCTTCCAGGAGCCCACTGACGTTGGAGTGCTAAAAATGCCCCTTCAGGGGGAAAACTGCATTTTCTCTTCCAA
AAAGGAAAGGTTCTTCCAGGCGAGAAACCTGTGGTCTAGAACCACAGCAAGAAGAGGAGGCATGCTGGCCTGCAC
CGGAAGACTCACTTTGTCTGCCCTGCGCCAGCCTCACCTCACCCTGCAGTTCCCGTTTCCGCCATGGATGCCTCA
TCACCAACCCTGACCTTCCCCCTCCCAACCCTTTATTCATCCTCACTCCCACTCATACCCGCCTCCCTGGACAGT
TCCCTGCTGCAGAGTTCTTTCTGCTTTCAGCCCTACCTTGGTGGTGATTTACCTGAAAATCTTCACAACTGATCA
TTATCTCCTTCTCTTTGAGACCTGACTGAAAAAATTAGGTGTGCACACCTGTA
```

FIGURE 396

MPETQPTDIPLLLFISQDSLPSSVISAISGQLQSYSDACEVLSVVEVTLGFLSTAGGDPNMQLNVYTQDILQMGD
QTIHVLKALNRCQLKHTIALWQFLSAHKSEQLLRLHKEPFGEISSRYKADLSPENAKLLSTFLNQTGLDAFLLEL
HEMIILKLKNPQTQTEERFRPQWSLRDTLVSYMQTKESEILPEMASQFPEEILLASCVSVWKTAAVLKWNREMR

FIGURE 397

```
GGGGCAGTATTCTGTGTTGAGGGAGGAAAAACACTCCCTTCCAAAAGCATGACAGGCAGAAAGCAGAGAAGGGCC
AGGACTGGCTGAGGGCGGGGAGCTGGGCCTCTGGGGTGGACACACCCTTGGTCACATTGTGAGGGTAGCTTGGTT
GGCCAGTCCCACCACTGCAGTGACCACAGTTGTGTTGGGCTCACACCAGTGAACCGAAGCTCTGGATTCTGAGAG
TCTGAGGATTCCGTGAAGATCTCAGACTTGGGCTCAGAGCAAGGATGCGTGAAATTGTCCATATTCAGATTGGCC
AGTGTGGCAACCAGATCGGAGCCAAGTTCTGGGAGATGATTGGTGAGGAACACGGGATCGACTTGGCTGGGAGCG
ACCGCGGGGCCTCGGCCTTGCAGCTGGAGAGAATCAGCGTGTACTACAACGAAGCCTACGGTAGGAAATATGTGC
CCCGAGCAGTCTTGGTGGACCTAGAACCTGGGACGATGGACAGCATTCGATCTAGCAAATTAGGAGCTCTCTTTC
AACCCGACAGTTTTGTCCATGGTAACTCTGGGGCTGGCAACAACTGGGCCAAAGGCCACTACACGGAGGGAGCCG
AGCTGATCGAGAATGTCCTAGAGGTGGTGAGGCACGAGAGTGAGAGCTGTGACTGCCTGCAGGGCTTCCAGATCG
TCCACTCCCTGGGCGGGGGCACAGGCTCCGGGATGGGCACTCTGCTCATGAACAAGATTAGAGAGGAGTACCCGG
ACCGGATCATGAATTCCTTCAGCGTCATGCCTTCTCCCAAGGTGTCGGACACGGTGGTGGAGCCCTACAACGCGG
TTCTGTCTATCCACCAGCTGATTGAGAATGCAGATGCCTGTTTCTGCATTGACAATGAGGCCCTCTATGACATCT
GCTTCCGTACCCTGAAGCTGACGACACCCACCTATGGGGATCTCAACGACCTAGTGTCCTTGACCATGAGCGGCA
TAACCACCTCCCTCCGGTTCCCGGGTCAGCTCAACGCAGACCTGCGCAAGCTGGCGGTGAACATGGTCCCCTTCC
CCCGCCTGCACTTCTTTATGCCCGGCTTTGCCCCACTCACGGCCCAGGGCAGCCAGCAGTACCGAGCCCTCTCCG
TGGCCGAGCTCACCCAGCAGATGTTCGATGCCCGCAATACCATGGCTGCCTGTGACCTCCGCCGTGGCCGCTACC
TCACAGTGGCCTGCATTTTCCGGGGCAAGATGTCCACCAAGGAAGTGGACCAGCAACTGCTCTCCGTGCAGACCA
GGAACAGCAGCTGCTTTGTGGAGTGGATTCCCAACAACGTCAAGGTGGCTGTCTGCGACATCCCGCCCCGGGGGC
TGAGCATGGCCGCCACCTTCATTGGCAACAACACGGCCATCCAAGAGATCTTTAATAGGGTCTCTGAGCATTTCT
CAGCCATGTTCAAAAGGAAAGCTTTTGTGCACTGGTACACCAGCGAAGGGATGGACATAAACGAATTTGGGGAAG
CTGAAAATAACATCCATGATTTGGTATCCGAGTACCAACAATTTCAAGATGCCAAAGCAGTTCTAGAGGAAGATG
AAGAGGTCACGGAGGAGGCAGAAATGGAGCCAGAAGATAAGGGACATTAACTGTGAGAGAAGCTGTGCCGCGGAG
TCGCTTACAGAACAGTTTCTCATTAGATGAGTGTTTCTCCTGCAGCACTCCAAAACCCACTCTGCACTGCAGCAC
AGTGAATGATATGCACTCACCATTAGCTTCGACACAGGGACTGAGGGAGACAGGTGGGGAGCAGCTGACAGGCAT
TAGGGTCTTTGCTGACATCTACTAACCTTGAAGAGTTTGATGTTCAGTGCATACTTATTAACTTAAAAAAATAGC
AAATTTATTGTAAAGTGCTCCCTTTGTTTCAAAGTGTTTGCCAGGCATCCAGACTACACGTGTGGATTTGCAGGG
AGCCACTGGAGTTGGTGTTACATTTTTATACTTTAGCAGCACTGATAGGCACCCTGGAATCCTCACTTGGTATCC
GAGGGCTACTAAGACTCTTTCCTTAGGTTCTTTCCTCTGAGCAAACACTGACTGGCATCCTGCTTTCCAGTGCCT
GCCAGCCTCCAGAAGAGCCAGGTGCCTGACTAGTACATGGGGAGCTACAGAGCCAAGGTCAATGTGAGTCAACAT
CCACTAGAAATATCCATGTTGTGTAGACCTGTGCATACAACATGCTAACTGGAAAAGAGGAAAAAAGAAAAGCCA
CAGTCCTCTCCACAAAAATACCTGGTCCAAACAAGAAAAACAAAAAGACAAGCAAAACTAAAGAACTGCAGTCTT
CTGATCTTTATTTCTGAAGAGCTAGCCTTTAACATATATGTTTATATAGTTTAAATTTCTTACTACTGTTAGATC
CCAGGAATTCATTAATAATCATCCTTGGCTTTCCTTTTAAAGGCTATTTTGAAATGGTCTTTTCACTTTCATTCA
GTCATCACCCCCCAAAATGCTCTGCAGCCTCTCTGCTCTTTGAGAAAGGGCACACCATGCGCTCGGCAACCATTC
AAATGCAGGAATTAAGCAGCAATGGCTGCAGTGTCCTTCTCAGTTATGGAGGACATCGTCTCATTAGGGAACTTT
TACAGTTCAAATTAATTTGCAGAAGTTGCCATAAATGTTTGCATAATGACATAGCTTTAGCACTACATGATTTTA
ATCTGCTCACATTATAACAGGACCAAATACACAAGAGCGTAATCAAATCATCTGTAACTTCTTAATTACAGTTTA
CCTATTTCTGACATGCAGCACTGCCATCTCTTCCAGCACCATCAGGGTTTTAATGGCCCTCTAGAATTACCACTG
AGATACACTATTTGATCCATGGATAACCGGTAATGGGAAAATGCTCCGACCCTCAATGCAGTAAATATTTACTTG
CAGGCAACTGGGTTCTCATCTCTTGATTTGCTTTTGTAATCAGCAATAATAAAATAGCAGGTAGATGGATGACAG
TTGCTCATTCTGAGAAACTTCACTCTTTTCACTTATGCATCACGAGGAAATAACTAAAATACATACCAAGAGAAA
AATACCTTGCCATCGGATCATCAACAAGTCTTCTATTTACAAACTTCAAAAAACACAAAACAACATTCATGTTTT
AAATGCTTTCTACTTGTGGTTCAAGAAGCACTAGATTTAGTAAGAAACTCTACCTATATACTTAGTTTGAAGTTA
GTAACTTCCTGAGATGCTAAAGACTTACAGCCTGCGATTATACAAGGATTTACACATGCTTCCTCTGGTGCTTTA
CTTCCCAAACCTAAAAAAGCAATGAAATAGATGTAAGGAAGGAGGGATTTAAACCTTTTAAAAAACTTTTGCTGA
CTTATATTACTGTAAAGATTTGTTTGCTCAATAGTAATCATTAAACTACAAAGTAATTCAATTTTAAATGGCAAA
ATTGCTTTATTTCAGACTAAATAAATTCCTTTTCTTGAAGCCTAA
```

FIGURE 398

MREIVHIQIGQCGNQIGAKFWEMIGEEHGIDLAGSDRGASALQLERISVYYNEAYGRKYVPRAVLVDLEPGTMDS
IRSSKLGALFQPDSFVHGNSGAGNNWAKGHYTEGAELIENVLEVVRHESESCDCLQGFQIVHSLGGGTGSGMGTL
LMNKIREEYPDRIMNSFSVMPSPKVSDTVVEPYNAVLSIHQLIENADACFCIDNEALYDICFRTLKLTTPTYGDL
NHLVSLTMSGITTSLRFPGQLNADLRKLAVNMVPFPRLHFFMPGFAPLTAQGSQQYRALSVAELTQQMFDARNTM
AACDLRRGRYLTVACIFRGKMSTKEVDQQLLSVQTRNSSCFVEWIPNNVKVAVCDIPPRGLSMAATFIGNNTAIQ
EIFNRVSEHFSAMFKRKAFVHWYTSEGMDINEFGEAENNIHDLVSEYQQFQDAKAVLEEDEEVTEEAEMEPEDKG
H

FIGURE 399

CGGACGCGTGGGGAGAGGCTGTTTACCAGAACAGCATAACAAGGGCAGGTCTGACTGCAAGGCTGGGACTGGGAG
GCAGAGCCGCCGCCAAGGGGGCCTCGGTTAAACACTGGTCGTTCAATCACCTGCAAGACGAAGGAGGCAAGGATG

CTGTTGGCCTGGGTACAAGCATTCCTCGTCAGCAACATGCTCCTAGCAGAAGCCTATGGATCTGGAGGCTGTTTC
TGGGACAACGGCCACCTGTACCGGGAGGACCAGACCTCCCCCGCGCCGGGCCTCCGCTGCCTCAACTGGCTGGAC
GCGCAGAGCGGGCTGGCCTCGGCCCCCGTGTCGGGGGCCGGCAATCACAGTTACTGCCGAAACCCGGACGAGGAC
CCGCGCGGGCCCTGGTGCTACGTCAGTGGCGAGGCCGGCGTCCCTGAGAAACGGCCTTGCGAGGACCTGCGCTGT
CCAGAGACCACCTCCCAGGCCCTGCCAGCCTTCACGACAGAAATCCAGGAAGCGTCTGAAGGGCCAGGTGCAGAT
GAGGTGCAGGTGTTCGCTCCTGCCAACGCCCTGCCCGCTCGGAGTGAGGCGGCAGCTGTGCAGCCAGTGATTGGG
ATCAGCCAGCGGGTGCGGATGAACTCCAAGGAGAAAAAGGACCTGGGAACTCTGGGCTACGTGCTGGGCATTACC
ATGATGGTGATCATCATTGCCATCGGAGCTGGCATCATCTTGGGCTACTCCTACAAGAGGGGGAAGGATTTGAAA
GAACAGCATGATCAGAAAGTATGTGAGAGGGAGATGCAGCGAATCACTCTGCCCTTGTCTGCCTTCACCAACCCC
ACCTGTGAGATTGTGGATGAGAAGACTGTCGTGGTCCACACCAGCCAGACTCCAGTTGACCCTCAGGAGGGCAGC
ACCCCCCTTATGGGCCAGGCCGGGACTCCTGGGGCCTGAGCCCCCCCAGTGGGCAGGAGCCCATGCAGACACTGG
TGCAGGACAGCCCACCCTCCTACAGCTAGGAGGAACTACCACTTTGTGTTCTGGTTAAAACCCTACCACTCCCCC
GCTTTTTTGGCGAATCCTAGTAAGAGTGACAGAAGCAGGTGGCCCTGTGGGCTGAGGGTAAGGCTGGGTAGGGTC
CTAACAGTGCTCCTTGTCCATCCCTTGGAGCAGATTTTGTCTGTGGATGGAGACAGTGGCAGCTCCCACAGTGAT
GCTGCTGCTAAGGGCTTCCAAACATTGCCTGCACCCCTGGAACTGAACCAGGGATAGACGGGGAGCTCCCCCAGG
CTCCTCTGTGCTTTACTAAGATGGCCTCAGTCTCCACTGTGGGCTTGAGTGGCATACACTGTTATTCATGGTTAA
GGTAAAGCAGGTCAAGGGATGGCATTGAAAAAATATATTTAGTTTTTAAAATATTTGGGATGGAACTCCCTACTG
ACCTCTGAGAACTGGAAACGAGTTTGTACAGAAGTCAGAACTTTGGGTTGGGAATGAGATCTAGGTTGTGGCTGC
TGGTATGCTTCAGCTTGCTGGCAATGATGTGCCTTGACAACCGTGGGCCAGGCCTGGGCCCAGGGACTCTTCCTG
TTTCATAAGGAAAGGAAGAATTGCACTGAGCATTCCACTTAGGAAGAGGATAGAGAAGGATCTGCTCCGCCTTTG
GCCACAGGAGCAGAGGCAGACCTGGGATGCCCCAGTTTCTCTTCAGGGATGGATAGTGACCTGTCTTCATTTTGC
ACAGGTAAGAGAGTAGTTAGCTAACCTATGGGAATTATACTGTGGGGCCTTGTGAGCTGCTTCTAAGAGGCTAAC
CTGGAAACTAAGCTCAGAGGCAAGGTAATAAAGCACTTCAGGGCTTGCTCCCAAGTGGGCCTGATTTAGCAGGT
GGTCCTGCGGGCGTCCAGGTCAGCACCTTCCTGTAGGGCACTGGGGCTAGGGTCACAGCCCCTAACTCATAAAGC
AATCAAAGAACCATTAGAAAGGGCTCATTAAGCCTTTTGGACACAGGACCCCAGAGAGGAAAAAGTGACTTGCCC
AAGGTCGTAAGCAAGCTACTGGCATGGCAAGAGCCCAGCTTCCTGACGGAGCGCAACATTCTCCACTGCACTGT
GCTAGCAGCTCAGCAGGGCCTCTAACCTGTGATGTCACACTCAAGAGGCCTTGGCAGCTCCTAGCCATAGAGCTT
CCTTTCCAGAACCCTTCCACTGCCCAATGTGGAGACAGGGGTTAGTGGGGCTTTCTATGGAGCCATCTGCTTTGG
GGACCTAGACCTCAGGTGGTCTCTTGGTGTTAGTGATGCTGGAGAAGAGAATATTACTGGTTTCTACTTTCTAT
AAAGGCATTTCTCTATATACATGTTTTATATACCTCATTCTGACACCTGCATATAGTGTGGGAAATTGCTCTGCA
TTTGACTTAATTAAAAAAAAAAAAAAAA

FIGURE 400

MLLAWVQAFLVSNMLLAEAYGSGGCFWDNGHLYREDQTSPAPGLRCLNWLDAQSGLASAPVSGAGNHSYCRNPDE
DPRGPWCYVSGEAGVPEKRPCEDLRCPETTSQALPAFTTEIQEASEGPGADEVQVFAPANALPARSEAAAVQPVI
GISQRVRMNSKEKKDLGTLGYVLGITMMVIIAIGAGIILGYSYKRGKDLKEQHDQKVCEREMQRITLPLSAFTN
PTCEIVDEKTVVVHTSQTPVDPQEGSTPLMGQAGTPGA

FIGURE 401

```
CCAAGCCCATGAGGGCCGCGCGCCCGGCCGCCGGTGCTGACGAGACGGAGCTCCTGGCCCCCGAGGAGGAGCAGA
GGATCAATGCGGTTCAAGAATCGATTCCAGCGGTTCATGAACCATCGAGCTCCAGCCAATGGCCGCTACAAGCCA
ACTTGCTATGAACATGCTGCTAACTGTTACACACACGCATTCCTCATTGTTCCGGCCATCGTGGGCAGTGCCCTC
CTCCATCGGCTGTCTGATGACTGCTGGGAAAAGATAACAGCATGGATTTATGGAATGGGACTCTGTGCCCTCTTC
ATCGCTTCTACAGTATTTCACATTGTATCATGGAAAAAGAGCCACTTAAGGACAGCGGAGCATTGTTTTCACATG
TGTGATAGAATGGTTATCTATTTCTTCATTGCTGCTTCTTATGCTCCATGGTTAAATCTTCGTGAACTTGGACCC
CTGGCATCTCATATGCGTTGGTTTATCTGGCTCATGGCAGCTGGAGGAACCATTTATGTATTTCTCTACCATGAA
AAATATAAGGTGGTTGAACTCTTTTTCTATCTCACAATGGGATTCTCTCCAGCCTTGGTGGTGACATCAATGAAC
AACACCGATGGACTTCAGGAACTTGCCTGTGGGGCTTAATTTATTGCTTGGGAGTTGTGTTCTTCAAGAGTGAT
GGCATCATTCCATTTGCCCACGCCATCTGGCACCTGTTTGTGGCCACGGCAGCTGCAGTGCATTACTACGCCATT
TGGAAATACCTTTACCGAAGTCCTACGGACTTTATGCGGCATTTATGACCAATCTGTACTAATTCTCCAAACCAG
TATTATTTCAATTATGGCACTTGGGAGTGGGGTGAGAGCTAAACATTGCACAGGGCAAAGAAAAAAAATAACTGC
ACTGACTTTATATCTTTTGAATATAATTACTGTGAAAGTATAAAGGCTGTGTTCTGGAATTTTCTGCCTCACAGC
AAATAAATAAGGTAGTGAATTAATTATTCATTCCATTCCACTATCATGAAGGACTCTGAATAGACTTGGCCAACT
GATGTTACAAACCAGACTTTTATATTTTAATTTTACAGATTTTACTACATGATTTTCTAAATTACTATGTCAG
GTTGTAAAAGTCAGTGCAATAACAAACCTTCCTTTTTAAGAAGAAAATTGTTTCTATTACTTTCCCATTCACTAG
GTAAAGAATCATGGACAGAACTTACACTACTTTTTACCATGTTTCATCTTGGCATAACATGGTTCTTTTTTAAAT
AGAAACTTTAGTTTTTTGTAAATTTTTAAAAAAATATTTCATTGATATGCATCTCTGCAGGTCCTCATTCATGTT
GTAAATTTTTGGAGCAAGCAGTCAACATTCCACAAACGAACAAACATTATACCTCTTCTGATAGTTTTATTAAGC
ATGGAGAAATTGCCAATTTTTAAAAACTGCAGTTTTCCAAACTTTTCTGCCAACCTCTTACTCTGAATTCAGTGC
TGCTTTGGGACATATACTTGACCTAGCTTGGTTTACCAGTGATGGAAAAGTATTTGATATCATTAACTTTTTCA
AAAGATCCAACTTTTTCTCTATGCCTTTGCCACATTCTCTTCAGGGTCTCTTTCCACAGCGGATAAATGTTTTTT
CTGTATTATGACAGTATTGTTGTGATGGCCATCTGCTGGAAACTCCTGAAGAGCATTATGTATTACAGTGAGCAG
TTGTATTGCCTGTTTGGTGCCCAATGGTTAAGTCATTGTCACTTAGCTTTATATTGTCAGTTTGATATTTATTTT
AAATTGTGGAACTAGATGCATAAATTCACATTTCTGCCTTTCCTTTGCATCTTCTCATATATTGTGTTTTTTTT
TTTTCCTAGAAAAAATATTTAAAGCATTGTTTGACAGGTAGAAACTCATGTATCTGTAGTCCATGAGTTATATC
CTGGCTCAGTGGAGTGATATTTATGTATTATTTTACTTTCTCTCAGTGTCTTATATTAAGATTAACATGTTGT
TAATAGTTGCTTTGTTGATTAATCTCTCTTGTTGGTGTTTTAATAAATGAAATAGGCTTGCCTTTAGATCGGGTG
CTGATATTGCCTGTTCCTAGTAATGGGCTGATCAAATGATCAGTGGAATTCTTGGTTTGATGATAACCTTATTA
ATTGAAATTTTTTACTGATGTGGCTTTAAAAGAGGTTTATTTTGTATATGTTTAGAACTCTCTGATTTGATGAA
TTATATGGGAGTGAGAAACAGAAGAAGTGGTATTTGCTGGCGAGTTAAATAGGCAAGGTACCCAGTGATAACACC
AACCAAACCACTCCTATCTGCATGATTCTGAACATCTGGATGCCTGTTGTTTTACTGTGTATATTTATTTTTAA
TATATTAACTTTGTGGATTCATTTAAGGTCTACTCAAAAGTAACACTGTCCAAACCACTAATATGTATGTAAAAA
TTGTGCTGTATACTACAATAAAGTTGTTACTTGGATTTGTTCCAAAAAAAAAAAAAAAA
```

FIGURE 402

MRFKNRFQRFMNHRAPANGRYKPTCYEHAANCYTHAFLIVPAIVGSALLHRLSDDCWEKITAWIYGMGLCALFIA
STVFHIVSWKKSHLRTAEHCFHMCDRMVIYFFIAASYAPWLNLRELGPLASHMRWFIWLMAAGGTIYVFLYHEKY
KVVELFFYLTMGFSPALVVTSMNNTDGLQELACGGLIYCLGVVFFKSDGIIPFAHAIWHLFVATAAAVHYYAIWK
YLYRSPTDFMRHL

FIGURE 403A

```
GAAGCCCGGCGGCGCGGCCCTCGTCCCCCTTCCCGACCCCCGGTCTGTCTCCTCGCTCCCTTCAGCCGCCTTCCG
CGCCGCCGCCTCTGCCGTTCGTCAGGCGGCCCGGCCCGGCCCGCCCGCCCCGCATCCCCCCCGGCGCGCTGAATG
CAGACTAATAGGGATGCCAAAGGAAAAATATGATCCTCCAGATCCTCGCAGAATTTATACCATCATGTCAGCAGA
GGAGGTAGCCAATGGGAAAAAATCTCACTGGGCAGAATTAGAAATCTCGGGTAGAGTGCGGAGCCTAAGTACATC
ACTTTGGTCATTGACACACTTGACAGCGCTGCACCTAAATGACAATTACCTTAGTCGCATTCCACCTGATATTGC
CAAGCTTCATAATCTGGTTTACCTGGATCTGTCATCCAATAAACTCAGAAGTTTACCAGCAGAACTAGGAAACAT
GGTGTCTCTCAGGGAATTGCTTTTAAATAACAATCTGTTACGGGTTTTGCCTTATGAACTTGGTCGGCTCTTCCA
GCTACAAACTCTAGGTTTGAAAGGCAATCCTTTATCACAGGATATTCTAACTTATACCAGGACCCAGATGGAAC
CCGAAAGCTACTGAACTTCATGCTTGACAATCTCGCAGTTCATCCAGAGCAGCTTCCTCCGAGGCCATGGATTAC
ATTAAAAGAACGAGACCAAATTCTGCCGTCAGCATCATTCACGGTTATGTGTTACAATGTGTTATGTGATAAATA
CGCTACCCGGCAGCTATATGGCTATTGCCCATCCTGGGCATTAAACTGGGAATACAGGAAAAAGGGAATTATGGA
AGAAATTGTTAACTGTGACGCAGATATCATTAGTCTTCAGGAAGTGGAAACAGAGCAATACTTCACTCTCTTTCT
GCCAGCATTGAAGGAGCGTGGATATGATGGATTTTTTCTCCAAAGTCACGTGCCAAAATCATGTCTGAGCAGGA
GAGAAAGCATGTAGATGGTTGTGCAATATTCTTCAAAACAGAAAAATTTACATTGGTGCAGAAGCATACAGTGGA
ATTTAACCAAGTGGCGATGGCTAATTCAGATGGATCCGAAGCTATGCTGAACAGAGTGATGACAAAAGATAACAT
TGGTGTCGCTGTGGTATTAGAGGTCCACAAAGAACTATTTGGAGCAGGTATGAAGCCTATTCATGCTGCAGACAA
ACAGCTGCTTATAGTGGCAAATGCCCACATGCATTGGGACCCAGAGTATTCTGATGTGAAGCTCATCCAGACCAT
GATGTTTGTCTCAGAGGTTAAAAACATTCTGGAGAAAGCCTCTAGTAGGCCTGGAAGCCCAACTGCAGATCCTAA
TTCCATCCCGCTGGTGCTATGTGCAGATCTTAACTCATTGCCAGATTCAGGTGTTGTGGAATACTTAAGCAATGG
AGGAGTAGCTGACAACCATAAAGACTTCAAGGAACTAAGGTACAATGAGTGTCTTATGAACTTCAGCTGCAATGG
AAAGAATGGAAGCTCAGAAGGGAGAATCACACATGGCTTCCAACTTAAGAGCGCCTATGAAAATAACTTGATGCC
TTACACCAATTACACCTTTGATTTCAAAGGCGTGATTGACTACATTTTCTATTCCAAGACTCATATGAACGTGCT
TGGTGTCCTGGGGCCTTTAGATCCTCAATGGCTGGTTGAGAACAACATCACTGGGTGTCCACACCCTCACATCCC
TTCAGACCACTTCTCACTGTTAACACAACTTGAACTCCACCCTCCACTCCTGCCTCTTGTCAATGGTGTTCACTT
GCCTAATCGGAGGTAGTGGAGTACTGCCCCGCCAAGACGGGGATCTGTTGCTATGGACCTGTACAGTTGTAAATC
AAAGTATGTAGGAGTGAAGTATGGCCATCCTTAAGCTGCTTCTTCAGGTTTCTTTCATTATGTGTTTGCTGTAAG
ACTTTGTACATTTTTGTGCATATTGGTATCATTTGGCAGTAGGGCTGGAACCAAAGTATTACTCTCTTACAAAA
TTTAATTTAACATGTTTTTAAATTGGACCTTCTTTATATTGTATTAACAGCCAGCATTCAAAATTGATAAATTA
CCAATTTGAGGCCCAATAACAGTGTATTTGTTTTTCCAAAACAAATACTTTCTTTTGAATGGTTTCAGTGAGCCA
ACCATTTTATAAAAGGCAATTTTTAAAAACTATAAATACAGTATTTTAAACTGAATGATGATATGCCTTCCAGGG
AAAACCTTGAATTTTTCCTTTATAACTGACTTTTGGATTCCAAAGTCATTTGCACATTAACAGAGTACTTAAATT
TACTTGTTCAGTCCATAAACTATGATATAGCCTCTATACATGGTAAGAAAATTTGAAAAATTAAAGATGGTTGCA
CAGTATACTTTTATAATCCAGCATGTAACACCACATGACAATTTGTTGGCCAAATGCTGGTTTGGAGTTTTTTG
AGGAATCACTTTGGTTTTTTTGTCCTTTATATATAACCTTATTGGAAGTATTAATTCTAAGCCTGTCTCTCAAGT
TTATTTATAGAGAAAAGTAAGTAATCTGTATTGCCACATACCTTGAAAATAGAATGTGGTATGTTTAGGATGCC
CACGGAATGAATTTTTCCTTATTCCAATTCAACCTTCTGTCTGGTTGTGCCAGGAAAACAGATGTTATATGACCT
ATGTCATTTTTGCCATTATAGTCAAATGTTAAAAGAAGAAAAAGTCTGCTGAATAAAAAGGCCTTGATCAAAGT
TTCAGATGGGGAAAATCATACAGATATTTTATGTGTTTCCAACATAGATTATGTGGCTGTTGGTTTCTTGAGATG
ACAGTGCAAAGGATTTGGGAGAGAGAACAAATTTGGGGCAGTAGTTGAAAACGTTGGGTCATTTCCTGACTCTA
GCTGCCAAATGGCCATCATATGCTTTTAATCTTTGTTTCAGTTGTCTGTCAGGGTTGAATTAAGAAGCTACTGGT
TTATTCCCAATTGTTGATGCCTTTAGGTATGTTGGAATCTTTTTTTGCCTAGGAGGGGCCAGTTGAAAATCTGT
GACTCAAGAGGCAGTGAACAGAATACTGTTTCTGGGGAAAATTGGTTGGCTACTTGATGTTAATTATGGCACA
GTAACAGGAAAAGGTTGTGTCTGTGTTTTAAGTTTTTCTTTATTCTGCTTTTTGCTGCTATAAGAGTTTTCTG
AAATTTATATTTTAAACTTTTCATGCACTTTACTGTTTCTAGTCTCAAAATGTGATATTTTAATAAACAAGAAA
TTTTCCATTATGTGAATGAAATTTTAAAAGACAATAGCCTATATTTGTGTCTCACTAATATATAAAGTATAGGTC
AAATTTAAATTATTTAATTAGTTTTAAATATACACAATTTGTCTCCTCTTTCAAACCTGACATCTTCGGCTGTTT
TATTAGTCTTAAATGATGCATTTACTTTGGTCATTTATGCTAATTTCTTCCATAGTAAATTAATCAGGCTATAT
AAGGTAATATTTCCCCAGAGGGTAATTTTAGTGGGACGAGGGTGGTGGGATGATGTCATATCATACATGGGATTG
```

FIGURE 403B

```
CATCAGAAGGGTTCTGTAAAGCCTGAACTCCCTTTTAAAAGTGCCTAGTGATAGAGGCGTTGTTTGTCATCTATT
ATAATTGGAATGTCATTGTAGTTCAGTGAATTTTGATGTAAATAAAATATCTTTTAAAAATGTTAAAGTACCAGG
ATAAACAAACAAAAAGAAACAACCCTTAAGATGACAGATTTTCCTCAACATGCAGGTTTCCCTTCTTATATACCT
CAAGTATCCAACATCTAGCCATGCAAATTGATTACCTGAAGCATAGTACTGGAAAGTAGAATAGCATGAAAAACT
TAATTTTGTGGACATTACCTTTTTTTGTAATCAGCTACTGTATGTTTATTTTAGATCTTTTGTTTGGGTGGGT
TTTCTGCTCTGGAGGTATATGCACTAACAAAACATTTTCCTCCTTTCATATACGCATGTTAATTAGCAATGTGAG
CAATATTTCCTACCATACTTCACTCCCAATATTTTTGAGATGTTTGTATAAAATGGAATTTAAAGTTCACTTAT
GATTGTATATGAACCACAGAGGAGCCCATTTATTAATAAAAAACTTTTTAATAGTTAAATGTAGAGGGAAAAAA
TAAAAAAAAAATGGGAAACATTGTAAACAGCTTAAGTTTATTTGTGTATGATCGAGGCACTCTGTTGCAGGAAG
GTGTGTAATTGGGTTCTCTCTGCTTCAAATGCGCTCTTCAAACCATTCATTATCCTGTGTATTTTAATGTGGT
TTTAGTAAATGTTGGTAGTAGCTCTGTTGAAGTAGGTAATTGTGTTATGTTTTGGGTGGTACACACTTGGGGCAT
GGTAACCCAAATTTCATGTGCACGGTTTCCCTTTAGCCCACTGCCCAAATTTCACATACCCTTCACCCTTTGTTC
CCTTTGTAAAAGGAGTGGTATCTGTTTTGAGCTGCCAATTCAGATGATCAGAAATGCTGCTTTCCTCAGCATTGT
CTTGTTAAACCGCATGCCATTTGGAACTTTGGCAGTGAGAAGCCAAAGGAAGAGGTGAATGACATATATATA
TATATTCAATGAAAGTAAAATGTATATGCTCATATACTTTCTAGTTATCAGAATGAGTTAAGCTTTATGCCATTG
GGCTGCTGCATATTTTAATCAGAAGATAAAAGAAAATCTGGGCATTTTAGAATGTGATACATGTTTTTTTAAAA
CTGTTAAATATTATTTCGATATTTGTCTAAGAACCGGAATGTTCTTAAAATTTACTAAAACAGTATTGTTTGAGG
AAGAGAAAACTGTACTGTTTGCCATTATTACAGTCGTACAAGTGCATGTCAAGTCACCCACTCTCTCAGGCATCA
GTATCCACCTCATAGCTTTACACATTTTGATGGGGAATATTGCAGCATCCTCAGGCCTGACATCTGGGAAAGGCT
CAGATCCACCTACTGCTCCTTGCTCGTTGATTTTGTTTTAAAATATTGTGCCTGGTGTCAACTTTTAAGCAACAG
CACTGCCTAAAAGCAAGCAGAGAACAGAATCCCAGCACCATTCTATAGGCAACTTTTTAGAATTCAGATATAGTA
AATCTGTTCCAGATTTATGATGTTTTATGTAAAAAAAATTTTGTATAATAACATAGCTGAATATTTTGTTTCAT
TTCTTTGATGTAAGGCGTGTGAACATTCGTTTGAATATCACATGTTGAAGTCAGGTATGGCACAATGGGTTCTGA
GACCAGCTTTTCCTCCCCTCCCATTTGCCTTGTTCCAAGCTCTTTCTTTTCAAATTACTTTCTGATATTCATAG
GCAGGTATTTAATTTTACTAATTAGCATCCTGTGTGAATGTATTAAAGAAGCCACTGTGTTTAGTGTAGTTGGC
AAAAATATAAAAGCTGTTTCTTATTTGCCCCTATTTTTTGGTGTCTTAAAGTTATATATTAAATCACAGAGAAG
CAAGGGAGAAAGTTGAAAGATATCTAAGGCTCATATCACTTGATTCTATGGTAGATTATATTAGAATTGATCAAT
TTCTTCATTGATACTGGAACATGGGCAAATATAGTGTTCCATCATGAAATTCTAAGTCTATACTGTTAAATGGGT
GAAAATTTAAGTTTATATTTGCATTTCCAAGCGTTTCTAAAAATCACTAATGCCATCTATACTTTTAGTATGAAA
CAGCAGACTATAGAAAGCACAGGGAAGAATAGGCTAAATACATTCTTTGAAGAACCAGAGGCATATAACCACATC
ATTATGTCATTCCTAATACATGGCTAGATTTTCTAATGATAAAATTGACTGTGTCCCAATGCTTATTTGATTCTA
AGCTTTTTTATTCTGTTTCTGAGATATTTTAATAGCTTTGCAAAATATGCTGACCAGTTTTTGGAAAATAATGGT
TTTTATAGCAAGCAAAGACTTTATGGCACATTTCAAAATAGCACTCATACATACTTACATTTGACAGAAATGT
GAATTCTCACATTGATGAGATATTTTTTCCCACCTGCCCTACCCTTTAAAAAAGGTCACCTTTCTAATGTGTAG
TAGATTCATTTACGCCTTTCCCTTTGAGTCATACCATGTTGGAGAACTGTGTGAATTGTAGGTAGAGAAATTAA
CTAGGGAAGCCAGAAGCTTGAACTAAAGTTTTAAATTTGTAGGCAGATGAGAACTTTTATACTATGGTTGCTTTG
GGCGATTCTAATTTTGTAATAGCATCATGATCACCAAAATTAATTCAAACATTTTAGTACATCTTTAATCTGTCT
TATTTACCAAAGTTCTAATCTGTTTAAGAACAGGATGCCAAGAGCATCTTTCATTTTATAGAATGATATGCTCAC
CTTTATAAGTGTCACCTAAAAGCTTGAGGGTAAAAAAGAAGCAGCCCATATATCTAAACTACAGGATGTCTTGAA
CAAGATTCACAGAAAGAAAGAAAAAAAAAGCAGTTCTTTCCAGGAAGGTGGTAAGGAAGAGCATGCATATTCTTG
TTTTAACCAAATACCTTTTTATGTAAATGTCTCTATTAAACCCCAGGTCCTACACCAGGAAATAGGGTGATAAC
CAGGAAAATACCAAGCTTTAACCCAGTTGGCAGTTCCTTGTGGCATACATTTGGTTAGACTTGGGTTTTCTTGG
AACCAAAGGAAAATAAGCATGTTGAGTTCCTCGTTCAACAGACATGACATTGAAGTAATAGAATATTTTTAAGT
AAAATAGTTTTCACTTTCAAAGCCTATGACATAAGGACATTTGTGCTTATTAATTGTAATTTTTTTTATGGTA
CATTGTATAAACTGAGTAGCATTGAACTGCATTTTAGAAGTATGTCATCAGAAACAAATCACATTATGGAAAGGA
TATACAAATGCCAAGTGATATGACTCTTTTGGCATGGTGGTAGCATGGTCCATTCAGCTTTCAGAATCTTTCGGA
GGCTCTAGTTTGGTGCCTAGTACTAGTTATTTTTGTTAGAACAATCTCTCAAAATTTAGATAATTTTCCAGTTGT
ATGTCTGTCACTTTTAACTCTAAAGCGTAAGAATCATGGTAACCCTCTCAGAAGTGGTCCTTTCTTGCTCATTTC
```

FIGURE 403C

```
AGTTTCGTATTAATTTCAAATCACTGATGTATTGTCTTTCAAGCTATCAATTGTTATATGTACCAATTTAATTTA
GTTTGTAGTTATCTGAAGTCACAAAATTGGTTCAGCATTGATGTCAAACAATGGCTTTGCTTCTTACCAAACAGA
CTTAGTATCCTGCTGCTTGTTTCAATCTTGATGCAGTAAGTGATGCAGTATCTGGGTCTGTATTTACTTAGAAAC
TGTACTGTCCTTTCTCTGTGCTTAACTTGCTAAAAATATATTCCCTTACCTGTGAAATTCCTGAGCGGTGCTCTG
CCAACTTTTCAAGGGGAGGGATTTGGATGGCTGTGTTACTGCACACTGGATCTGGAATTGTTCAGGGTTATGAGT
GACAAATTTCTTAAACACCAGCAGCACTGAGATGTGCACTATGGGCATTCGTACAGTTGTTGTCCAAATGCAAAC
AACTTTTTCATCTTGGAGAAGCTGAGATACAGAGTTCAATAGAACTACTTGGAATATTTTGAGAAGGTTGAATGT
TTCATCTTTGGCTTTGTTGTCTCTGGAGTGGGGAAGTATGGAGGGCTTTTTTTTTTTTTTAAAGAGAGTGTGTA
TGTACTTTTCTCTCTATAAGGGCCAGGGTGTTGGTCAAATTCACCATCGATTAATTTATATCTTCTGTTGTGAT
TTTTTTCAACTATATAACAAGTGCCAACTAATTGTCCATGGGACAATCTACTTTTCCACTCAATTTATCGTTTTG
AGTAGGGAAAGGTTCATTTATTTTCATTACCTGGCATTAAGTTAAAGAATTCATTATTTTGCATACATTTGAGTC
ATTCTGTGACCTATAAAGTGTTTTTGTAACTATCTAATTCTAATGGTTGCAAAGCAAAGCACATGACTGTAAAAC
CAAGCAAGGTGTTTTAGTAACTTTTTCCCTGAATACTTGGTAGTTTCCATTGATACTATTCCAAAACAAATTCTG
CTGTTTTAGGTTGTATATTTACTTTGCTTTTGTTCTAAGAAAAAGCCAAGGACTAAATCAACTTGTTTTTGTGTT
TCAGTAATCAGTTTAAAATCTAAGATTTTTTTTAAATTAGACTATTTAATGAAGTGCCATGTAATTGTAGCTTG
CTAGTGTTTAATGTTTAATAGACTGGTTCTGTAGGTGTTTTAACCATTTAACACTCTCTGCCATCCCTGGAGAAA
GTGGTTCTACTCTTACTGAACACATTCTCTCTGACAAAATCACCAGCTGCTTTATTTTTCTATTTATTACAGTTA
AACAGTTGATGAGGTCTGAATCTTGACCAAAACTGCTCAGCTGAGATGTTTTTCACAATAGACACTGTACAAAGT
GTGCGTGCAAAAGGACACGGTTGGTAGTATTTTTTCATTAATGTGAACATTGACTAAAAAAAAGCAGTCCTGCCT
TTTAAATCTTGTGGCAGCTCAGAAGGGAGGTGCTTAAGAACCTTAACTACTATGTCAGATAACAAAATATTTTTT
TCCATTTTGGAGATTGGTTACTGCTCACACATGATGTATAGGGCTAAATATATGCTTGTTTCCTTGCACCTGTGT
ACTTCCCCTCTCTCCCTCCCTTTCCTTCCCCTGTAGGCAATAAATGGCCATTTTGCAACTGCAT
```

FIGURE 404

KPGGAALVPLPDPRSVSSLPSAAFRAAASAVRQAARPGPPAPHPPRRAECRLIGMPKEKYDPPDPRRIYTIMSAE
EVANGKKSHWAELEISGRVRSLSTSLWSLTHLTALHLNDNYLSRIPPDIAKLHNLVYLDLSSNKLRSLPAELGNM
VSLRELLLNNNLLRVLPYELGRLFQLQTLGLKGNPLSQDILNLYQDPDGTRKLLNFMLDNLAVHPEQLPPRPWIT
LKERDQILPSASFTVMCYNVLCDKYATRQLYGYCPSWALNWEYRKKGIMEEIVNCDADIISLQEVETEQYFTLFL
PALKERGYDGFFSPKSRAKIMSEQERKHVDGCAIFFKTEKFTLVQKHTVEFNQVAMANSDGSEAMLNRVMTKDNI
GVAVVLEVHKELFGAGMKPIHAADKQLLIVANAHMHWDPEYSDVKLIQTMMFVSEVKNILEKASSRPGSPTADPN
SIPLVLCADLNSLPDSGVVEYLSNGGVADNHKDFKELRYNECLMNFSCNGKNGSSEGRITHGFQLKSAYENNLMP
YTNYTFDFKGVIDYIFYSKTHMNVLGVLGPLDPQWLVENNITGCPHPHIPSDHFSLLTQLELHPPLLPLVNGVHL
PNRR

FIGURE 405A

```
AGATGGCTGCCGACAGTGAGCCCGAATCCGAGGTATTTGAGATCACGGACTTCACCACTGCCTCGGAATGGGAAA
GGTTTATTTCCAAAGTTGAAGAAGTCTTGAATGACTGGAAACTGATTGGAAACTCTTTGGGAAAGCCACTCGAAA
AGGGTATATTTACTTCTGGCACATGGGAAGAGAAATCAGATGAAATTTCCTTTGCTGACTTCAAGTTCTCAGTCA
CTCATCATTATCTTGTACAAGAGTCCACTGATAAAGAAGGAAAGGATGAGTTATTAGAGGATGTTGTTCCACAAT
CTATGCAAGATTTGCTGGGTATGAATAATGACTTTCCTCCAAGAGCACATTGCCTGGTAAGATGGTATGGGCTAC
GTGAGTTCGTGGTGATTGCCCCTGCTGCACACAGTGACGCTGTTCTCAGCGAATCTAAGTGCAACCTTCTTCTGA
GTTCTGTTTCTATTGCCTTGGGAAACACTGGCTGTCAGGTGCCACTCTTTGTGCAAATTCACCACAAATGGCGAA
GAATGTATGTAGGAGAATGTCAAGGTCCTGGTGTACGAACTGATTTCGAAATGGTTCATCTTAGAAAAGTGCCAA
ATCAGTACACTCACTTATCAGGTCTGCTGGATATCTTCAAATCAAAGATTGGATGTCCTTTAACTCCATTGCCTC
CAGTTAGTATTGCTATTCGATTTACCTATGTACTTCAAGATTGGCAGCAGTATTTTGGCCTCAGCAACCTCCAG
ACATAGATGCCCTTGTAGGAGGAGAAGTTGGAGGCTTGGAGTTTGGCAAGTTACCATTGGTGCCTGCGAAGATC
CTATTAGTGAACTCCATTTAGCTACTACATGGCCTCATCTGACCGAAGGGATCATTGTGGATAATGATGTTTATT
CTGATTTGGATCCTATTCAAGCTCCACATTGGTCTGTTAGAGTTCGAAAAGCTGAGAATCCTCAGTGTTTGCTAG
GTGATTTTGTCACTGAATTTTTTAAAATTTGCCGTCGAAAGGAGTCAACTGATGAGATTCTTGGACGATCTGCAT
TTGAGGAAGAAGGCAAAGAAACTGCTGATATAACTCATGCTTTGTCAAAATTGACAGAGCCGGCATCAGTTCCAA
TTCATAAATTATCAGTTTCAAATATGGTACACACTGCAAAGAAGAAAATCCGAAAACACAGAGGTGTAGAGGAGT
CACCGCTAAATAATGATGTTCTTAATACTATTCTCCTGTTCTTATTCCCTGATGCTGTTTCTGAGAAACCATTAG
ATGGAACTACTTCAACAGATAATAATAATCCTCCATCAGAGAGTGAAGACTATAATCTCTACAATCAGTTCAAGT
CTGCACCATCTGACAGTTTAACATACAAACTGGCTTTGTGTCTCTGTATGATCAATTTTTACCATGGAGGGTTGA
AAGGAGTGGCACACCTCTGGCAGGAATTTGTTCTTGAAATGCGTTTCCGATGGGAAAACAACTTTCTGATTCCAG
GATTAGCAAGTGGACCCCCAGATCTGAGGTGTTGTTTACTGCATCAGAAACTACAGATGTTAAATTGTTGTATTG
AAAGAAAGAAGGCACGTGATGAGGGGAAAAAGACAAGTGCTTCAGATGTCACTAATATATATCCAGGGGATGCTG
GAAAAGCAGGAGACCAGTTGGTGCCAGATAATCTAAAAGAAACAGATAAGGAAAAGGGAGAGGTAGGAAAATCTT
GGGATTCCTGGAGTGACAGCGAAGAAGAATTTTTTGAATGCCTAAGTGATACTGAAGAACTTAAAGGAAATGGAC
AAGAGAGTGGCAAGAAAGGAGGACCTAAGGAGATGGCAAATTTAAGGCCGGAAGGACGGCTCTATCAGCATGGGA
AACTTACACTGCTGCATAATGGAGAACCTCTCTACATTCCAGTAACCCAGGAACCAGCACCTATGACAGAAGATC
TGCTAGAAGAGCAGTCTGAAGTTTTAGCTAAATTAGGTACATCGGCAGAGGGGCTCACCTTCGAGCACGCATGC
AGAGTGCCTGTCTGCTCTCAGATATGGAGTCTTTTAAGGCAGCTAATCCAGGTTGCTCCCTGGAAGATTTTGTGA
GGTGGTATTCACCCCGGGATTATATTGAAGAGGAGGTGATTGATGAAAAGGGCAATGTGGTGCTGAAAGGAGAAC
TGAGTGCCCGGATGAAGATTCCAAGCAATATGTGGGTAGAAGCCTGGGAAACAGCTAAGCCAATTCCTGCTAGAA
GGCAAAGGAGACTCTTTGATGATACACGGGAAGCAGAAAAGGTGCTGCACTATCTGGCAATCCAGAAACCTGCAG
ACCTTGCTCGGCACCTGTTACCTTGTGTGATTCATGCAGCTGTACTCAAGGTAAAGGAAGAAGAAAGTCTCGAAA
ACATTTCTTCAGTTAAGAAGATCATAAAGCAGATAATATCCCATTCCAGTAAAGTTTTGCACTTCCCCAATCCAG
AAGACAAGAAATTGGAAGAAATCATTCACCAGATTACTAATGTGGAAGCTCTCATTGCCAGAGCTCGGTCACTAA
AAGCCAAGTTTGGAACTGAGAAATGTGAACAGGAGGAGGAAAAGGAAGATCTTGAAAGGTTTGTGAGTTGCCTGC
TGGAGCAGCCTGAAGTGTTAGTCACCGGTGCAGGAAGAGGACATGCTGGCAGGATCATTCACAAGCTGTTTGTGA
ATGCCCAGAGGGCTGCAGCTATGACTCCACCAGAGGAGGAATTGAAGAGAATGGGCTCCCCAGAGGAAAGAAGGC
AGAACTCCGTGTCAGACTTCCCACCCCCTGCTGGCCGGGAATTCATTTTGCGCACCACTGTGCCGCGCCCTGCTC
CCTACTCCAAAGCTCTGCCTCAGCGGATGTACAGTGTTCTCACCAAAGAGGACTTTAGACTTGCAGGTGCCTTTT
CATCAGATACTTCCTTCTTCTGATTCTTCTAGCATTACTCGTTGGTGGCTTCAGAGACAGTGCTGCCTCCTCCTG
AGGGAGGGAAGGTACCAGGGAGAACCTGGGAGGTCCTGGAGAGGGCCCTGTCCAGTTGGGTGATCAGGAATCAAA
CCAGCATCGGAAAGACTTCCCAGCACCAAGCTTGAGCTGTGTCGTTTCGTGGAGGGGGCAGCGAGGATGGGCTTG
AGCTGTTGAGAGATTTCTGCCCTAGAGATGGCCTTTGTATATGGGGGGGTGGTGGGGGGACACAAACACATCAGA
CACTCCGTCCTCACACTGGCAGGACGGTGTTCATCGCATTCTCTTCTGTGACCAGCCTCAGGCTAGCGGCTGCA
TTCGTGGTCTGTGCAAACACTTCGTGGTTCTATATATCAGCAGCAAGTGTGCAAAATAAAGGACCTGTTAACTCA
GATTTCTGGATATTTTGGTGGTAGCTTCTAGTCCCAGAATCTGTGTTTTTAAAATACTACATGACATTCTGTCTA
TTCAATCACCTGGTGGTCATCTTTCTTGTACTAATTAACTGTTGATGAGCATTTTGGATATTCTAGGAGAAAGCC
TATAATTTCACATAGTTTCTCTTTTTCATGTAACTGTAACCTAAATGTATTACTTCTGATAAAACTATATATCAA
```

FIGURE 405B

ATGTCACTGCAAATTAGTTTTATATCTGTCATGTG

FIGURE 406

MAADSEPESEVFEITDFTTASEWERFISKVEEVLNDWKLIGNSLGKPLEKGIFTSGTWEEKSDEISFADFKFSVT
HHYLVQESTDKEGKDELLEDVVPQSMQDLLGMNNDFPPRAHCLVRWYGLREFVVIAPAAHSDAVLSESKCNLLLS
SVSIALGNTGCQVPLFVQIHHKWRRMYVGECQGPGVRTDFEMVHLRKVPNQYTHLSGLLDIFKSKIGCPLTPLPP
VSIAIRFTYVLQDWQQYFWPQQPPDIDALVGGEVGGLEFGKLPFGACEDPISELHLATTWPHLTEGIIVDNDVYS
DLDPIQAPHWSVRVRKAENPQCLLGDFVTEFFKICRRKESTDEILGRSAFEEEGKETADITHALSKLTEPASVPI
HKLSVSNMVHTAKKKIRKHRGVEESPLNNDVLNTILLFLFPDAVSEKPLDGTTSTDNNNPPSESEDYNLYNQFKS
APSDSLTYKLALCLCMINFYHGGLKGVAHLWQEFVLEMRFRWENNFLIPGLASGPPDLRCCLLHQKLQMLNCCIE
RKKARDEGKKTSASDVTNIYPGDAGKAGDQLVPDNLKETDKEKGEVGKSWDSWSDSEEEFFECLSDTEELKGNGQ
ESGKKGGPKEMANLRPEGRLYQHGKLTLLHNGEPLYIPVTQEPAPMTEDLLEEQSEVLAKLGTSAEGAHLRARMQ
SACLLSDMESFKAANPGCSLEDFVRWYSPRDYIEEEVIDEKGNVVLKGELSARMKIPSNMWVEAWETAKPIPARR
QRRLFDDTREAEKVLHYLAIQKPADLARHLLPCVIHAAVLKVKEEESLENISSVKKIIKQIISHSSKVLHFPNPE
DKKLEEIIHQITNVEALIARARSLKAKFGTEKCEQEEEKEDLERFVSCLLEQPEVLVTGAGRGHAGRIIHKLFVN
AQRAAAMTPPEEELKRMGSPEERRQNSVSDFPPPAGREFILRTTVPRPAPYSKALPQRMYSVLTKEDFRLAGAFS
SDTSFF

FIGURE 407

ACTGAACTTTGAGCTTCAGGCAGCACAACTCACATTTGTGCAAAGAGCTACATGCCACATGCTGTTCTCCAGCCT
GCTGTGTGTATTTGTGGCCTTCAGCTACTCTGGATCAAGTGTGGCCCAGAAGGTTACTCAAGCCCAGTCATCAGT
ATCCATGCCAGTGAGGAAAGCAGTCACCCTGAACTGCCTGTATGAAACAAGTTGGTGGTCATATTATATTTTTG
GTACAAGCAACTTCCCAGCAAAGAGATGATTTTCCTTATTCGCCAGGGTTCTGATGAACAGAATGCAAAAAGTGG
TCGCTATTCTGTCAACTTCAAGAAAGCAGCGAAATCCGTCGCCTTAACCATTTCAGCCTTACAGCTAGAAGATTC
AGCAAAGTACTTTTGTGCTCTTGGGGAATCCTTCCTGCCCTTTCGGGGAACTTCCATTACACCGATAAACTCAT
CTTTGGAAAAGGAACCCGTGTGACTGTGGAACCAAGAAGTCAGCCTCATACCAAACCATCCGTTTTGTCATGAA
AAATGGAACAAATGTCGCTTGTCTGGTGAAGGAATTCTACCCCAAGGATATAAGAATAAATCTCGTGTCATCCAA
GAAGATAACAGAGTTTGATCCTGCTATTGTCATCTCTCCCAGTGGGAAGTACAATGCTGTCAAGCTTGGTAAATA
TGAAGATTCAAATTCAGTGACATGTTCAGTTCAACACGACAATAAAACTGTGCACTCCACTGACTTTGAAGTGAA
GACAGATTCTACAGATCACGTAAAACCAAAGGAAACTGAAAACACAAAGCAACCTTCAAAGAGCTGCCATAAACC
CAAAGCCATAGTTCATACCGAGAAGGTGAACATGATGTCCCTCACAGTGCTTGGGCTACGAATGCTGTTTGCAAA
GACTGTTGCCGTCAATTTTCTCTTGACTGCCAAGTTATTTTTCTTGTAAGGCTGACTGGCATGAGGAAGCTACAC
TCCTGAAGAAACCAAAGGCTTACAAAAATGCATCTCCTTGGCTTCTGACTTCTTTGTGATTCAAGTTGACCTGTC
ATAGCCTTGTTAAAATGGCTGCTAGCCAAACCACTTTTTCTTCAAAGACAACAAACCCAGCTCATCCTCCAGCTT
GATGGGAAGACAAAAGTCCTGGGGAAGGGGGGTTTATGTCCTAACTGCTTTGTATGCTGTTTATAAAGGGATAG
AAGGAAAAAAAAAAAAAAAAAAAAAAAAAAAAA

FIGURE 408

MLFSSLLCVFVAFSYSGSSVAQKVTQAQSSVSMPVRKAVTLNCLYETSWWSYYIFWYKQLPSKEMIFLIRQGSDE
QNAKSGRYSVNFKKAAKSVALTISALQLEDSAKYFCALGESFLPFRGNFHYTDKLIFGKGTRVTVEPRSQPHTKP
SVFVMKNGTNVACLVKEFYPKDIRINLVSSKKITEFDPAIVISPSGKYNAVKLGKYEDSNSVTCSVQHDNKTVHS
TDFEVKTDSTDHVKPKETENTKQPSKSCHKPKAIVHTEKVNMMSLTVLGLRMLFAKTVAVNFLLTAKLFFL

FIGURE 409

```
GGAGTGGCCATTCGACGACAGTGTGGTGTAAAGGAATTCATTAGCCATGGATGTATTCATGAAAGGACTTTCAAA
GGCCAAGGAGGGAGTTGTGGCTGCTGCTGAGAAAACCAAACAGGGTGTGGCAGAAGCAGCAGGAAAGACAAAAGA
GGGTGTTCTCTATGTAGGCTCCAAAACCAAGGAGGGAGTGGTGCATGGTGTGGCAACAGTGGCTGAGAAGACCAA
AGAGCAAGTGACAAATGTTGGAGGAGCAGTGGTGACGGGTGTGACAGCAGTAGCCCAGAAGACAGTGGAGGGAGC
AGGGAGCATTGCAGCAGCCACTGGCTTTGTCAAAAAGGACCAGTTGGGCAAGAATGAAGAAGGAGCCCCACAGGA
AGGAATTCTGGAAGATATGCCTGTGGATCCTGACAATGAGGCTTATGAAATGCCTTCTGAGGAAGGGTATCAAGA
CTACGAACCTGAAGCCTAAGAAATATCTTTGCTCCCAGTTTCTTGAGATCTGCTGACAGATGTTCCATCCTGTAC
AAGTGCTCAGTTCCAATGTGCCCAGTCATGACATTTCTCAAAGTTTTTACAGTGTATCTCGAAGTCTTCCATCAG
CAGTGATTGAAGTATCTGTACCTGCCCCCACTCAGCATTTCGGTGCTTCCCTTTCACTGAAGTGAATACATGGTA
GCAGGGTCTTTGTGTGCTGTGGATTTTGTGGCTTCAATCTACGATGTTAAAACAAATTAAAAACACCTAAGTGAC
TACCACTTATTTCTAAATCCTCACTATTTTTTTGTTGCTGTTGTTCAGAAGTTGTTAGTGATTTGCTATCATATA
TTATAAGATTTTTAGGTGTCTTTTAATGATACTGTCTAAGAATAATGACGTATTGTGAAATTGTTAATATATAT
AATACTTAAAAATATGTGAGCATGAAACTATGCACCTATAAATACTAAATATGAAATTTTACCATTTTGCGATGT
GTTTTATTCACTTGTGTTTGTATATAAATGGTGAGAATTAAAATAAAACGTTATCTCATTGCAAAAATATTTTAT
TTTTATCCCATCTCACTTTAATAATAAAAATCATGCTTATAAGCAACATGAATTAAGAACTGACACAAAGGACAA
AAATATAAAGTTATTAATAGCCATTTGAAGAAGGAGGAATTTTAGAAGAGGTAGAGAAAATGGAACATTAACCCT
ACACTCGGAATTCCCTGAAGCAACACTGCCAGAAGTGTGTTTGGTATGCACTGGTTCCTTAAGTGGCTGTGATT
AATTATTGAAAGTGGGGTGTTGAAGACCCCAACTACTATTGTAGAGTGGTCTATTTCTCCCTTCAATCCTGTCAA
TGTTTGCTTTATGTATTTGGGGAACTGTTGTTTGATGTGTATGTGTTTATAATTGTTATACATTTTTAATTGAG
CCTTTTATTAACATATATTGTTATTTTGTCTCGAAATAATTTTTAGTTAAAATCTATTTTGTCTGATATTGGT
GTGAATGCTGTACCTTTCTGACAATAAATAATATTCGACCATG
```

FIGURE 410

MDVFMKGLSKAKEGVVAAAEKTKQGVAEAAGKTKEGVLYVGSKTKEGVVHGVATVAEKTKEQVTNVGGAVVTGVT
AVAQKTVEGAGSIAAATGFVKKDQLGKNEEGAPQEGILEDMPVDPDNEAYEMPSEEGYQDYEPEA

FIGURE 411

```
ACTCTTCTGGTCCCCACAGACTCAGAGAGAACCCACCATGGTGCTGTCTCCTGCCGACAAGACCAACGTCAAGGC
CGCCTGGGGTAAGGTCGGCGCGCACGCTGGCGAGTATGGTGCGGAGGCCCTGGAGAGGATGTTCCTGTCCTTCCC
CACCACCAAGACCTACTTCCCGCACTTCGACCTGAGCCACGGCTCTGCCCAGGTTAAGGGCCACGGCAAGAAGGT
GGCCGACGCGCTGACCAACGCCGTGGCGCACGTGGACGACATGCCCAACGCGCTGTCCGCCCTGAGCGACCTGCA
CGCGCACAAGCTTCGGGTGGACCCGGTCAACTTCAAGCTCCTAAGCCACTGCCTGCTGGTGACCCTGGCCGCCCA
CCTCCCCGCCGAGTTCACCCCTGCGGTGCACGCCTCCCTGGACAAGTTCCTGGCTTCTGTGAGCACCGTGCTGAC
CTCCAAATACCGTTAAGCTGGAGCCTCGGTAGCCGTTCCTCCTGCCCGCTGGGCCTCCCAACGGGCCCTCCTCCC
CTCCTTGCACCGGCCCTTCCTGGTCTTTGAATAAAGTCTGAGTGGGCGGC
```

FIGURE 412

MVLSPADKTNVKAAWGKVGAHAGEYGAEALERMFLSFPTTKTYFPHFDLSHGSAQVKGHGKKVADALTNAVAHVD
DMPNALSALSDLHAHKLRVDPVNFKLLSHCLLVTLAAHLPAEFTPAVHASLDKFLASVSTVLTSKYR

FIGURE 413

ATGTGGCTCTTCTTCGGGATCACTGGATTGCTGACGGCAGCCCTCTCAGGTCATCCATCTCCAGCCCCACCTGAC
CAGCTCAACACCAGCAGTGCAGAGAGTGAGCTCTGGGAGCCAGGGGAGCGGCTTCCGGTCCGTCTGACAAACGGG
AGCAGCAGCTGCAGCGGGACGGTGGAGGTGCGGCTCGAGGCGTCCTGGGAGCCCGCGTGCGGGGCGCTCTGGGAC
AGCCGCGCCGCCGAGGCCGTGTGCCGAGCACTGGGCTGCGGCGGGGCGGAGGCCGCCTCTCAGCTCGCCCCGCCG
ACCCCTGAGCTGCCGCCCCGCCTGCAGCCGGGAACACCAGCGTAGCAGCTAATGCCACTCTGGCCGGGGCGCCC
GCCCTCCTGTGCAGCGGCGCCGAGTGGCGGCTCTGCGAGGTGGTGGAGCACGCGTGCCGCAGCGACGGGAGGCGG
GCCCGTGTCACCTGTGCAGAGAACCGCGCGCTGCGCCTGGTGGACGGTGGCGGCGCCTGCGCCGGCCGCGTGGAG
ATGCTGGAGCATGGCGAGTGGGGATCAGTGTGCGATGACACTTGGGACCTGGAGGACGCCCACGTGGTGTGCAGG
CAACTGGGCTGCGGCTGGGCAGTCCAGGCCCTGCCCGGCTTGCACTTCACGCCCGGCCGCGGGCCTATCCACCGG
GACCAGGTGAACTGCTCGGGGGCCGAAGCTTACCTGTGGGACTGCCCGGGGCTGCCAGGACAGCACTACTGCGGC
CACAAGAGGACGCGGGCGTGGTGTGCTCAGAGCACCAGTCCTGGCGCCTGACAGGGGGCGCTGACCGCTGCGAG
GGGCAGGTGGAGGTACACTTCCGAGGGGTCTGGAACACAGTGTGTGACAGTGAGTGGTACCCATCGGAGGCCAAG
GTGCTCTGCCAGTCCTTGGGCTGTGGAACTGCGGTTGAGAGGCCCAAGGGGCTGCCCCACTCCTTGTCCGGCAGG
ATGTACTACTCATGCAATGGGGAGGAGCTCACCCTCTCCAACTGCTCCTGGCGGTTCAACAACTCCAACCTCTGC
AGCCAGTCGCTGGCAGCCAGGGTCCTCTGCTCAGCTTCCCGGAGTTTGCACAATCTGTCCACTCCCGAAGTCCCT
GCAAGTGTTCAGACAGTCACTATAGAATCTTCTGTGACAGTGAAAATAGAGAACAAGGAATCTCGGGAGCTAATG
CTCCTCATCCCCTCCATCGTTCTGGGAATTCTCCTCCTTGGCTCCCTCATCTTCATAGCCTTCATCCTCTTGAGA
ATTAAAGGAAAATATGCCCTCCCCGTAATGGTGAACCACCAGCACCTACCCACCACCATCCCGGCAGGGAGCAAT
AGCTATCAACCGGTCCCCATCACCATCCCCAAAGAAGTTTTCATGCTGCCCATCCAGGTCCAGGCCCCGCCCCCT
GAGGACTCAGACTCTGGCTCGGACTCAGACTATGAGCACTATGACTTCAGCGCCCAGCCTCCTGTGGCCCTGACC
ACCTTCTACAATTCCCAGCGGCATCGGGTCACAGATGAGGAGGTCCAGCAAAGCAGGTTCCAGATGCCACCCTTG
GAGGAAGGACTTGAAGAGTTGCATGCCTCCCACATCCCAACTGCCAACCCTGGACACTGCATTACAGACCCGCCA
TCCCTGGGCCCTCAGTATCACCCGAGGAGCAACAGTGAGTCGAGCACCTCTTCGGGGGAGGATTACTGCAATAGT
CCCAAAAGCAAGCTGCCTCCATGGAACCCCCAGGTGTTTTCTTCAGAGAGGAGTTCCTTCCTGGAGCAGCCCCCA
AACTTGGAGCTGGCCGGCACCCAGCCAGCCTTTTCAGCAGGGCCCCCGGCTGATGACAGCTCCAGCACCTCATCC
GGGGAGTGGTACCAGAACTTCCAGCCACCACCCCAGCCCCCTTCGGAGGAGCAGTTTGGCTGTCCAGGGTCCCCC
AGCCCTCAGCCTGACTCCACCGACAACGATGACTACGATGACATCAGCGCAGCCTAGGCC

FIGURE 414

MWLFFGITGLLTAALSGHPSPAPPDQLNTSSAESELWEPGERLPVRLTNGSSSCSGTVEVRLEASWEPACGALWD
SRAAEAVCRALGCGGAEAASQLAPPTPELPPPPAAGNTSVAANATLAGAPALLCSGAEWRLCEVVEHACRSDGRR
ARVTCAENRALRLVDGGGACAGRVEMLEHGEWGSVCDDTWDLEDAHVVCRQLGCGWAVQALPGLHFTPGRGPIHR
DQVNCSGAEAYLWDCPGLPGQHYCGHKEDAGVVCSEHQSWRLTGGADRCEGQVEVHFRGVWNTVCDSEWYPSEAK
VLCQSLGCGTAVERPKGLPHSLSGRMYYSCNGEELTLSNCSWRFNNSNLCSQSLAARVLCSASRSLHNLSTPEVP
ASVQTVTIESSVTVKIENKESRELMLLIPSIVLGILLLGSLIFIAFILLRIKGKYALPVMVNHQHLPTTIPAGSN
SYQPVPITIPKEVFMLPIQVQAPPPEDSDSGSDSDYEHYDFSAQPPVALTTFYNSQRHRVTDEEVQQSRFQMPPL
EEGLEELHASHIPTANPGHCITDPPSLGPQYHPRSNSESSTSSGEDYCNSPKSKLPPWNPQVFSSERSSFLEQPP
NLELAGTQPAFSAGPPADDSSSTSSGEWYQNFQPPPQPPSEEQFGCPGSPSPQPDSTDNDDYDDISAA

FIGURE 415

ACTCGCGCGGATGCTGCAGGGGGCACTTCTGAATAAGATCAATGTTGGAAATTTTGTTTCTTCCTCTCAGTTCCT
TCATTTTTTTTCACATCGATCCTATCTACCAGCCCAAAGGTGGAGTGTATTTCAGGGGAGCATATTGGGCCATAG
TACTGGAGAATGTTTGCTGACCCACAATTTAGGGTCTCACTTAAAATCCTAGTTCTGCCATTTCCTAGCTGTGAT
GTACCTAGGTAAATTATTCCATCCAGTTGCATCTCTTTTTATCTTCCTCTGTTAAATAATAGTATACTCCACAGA
GAGCTCCTGTGAGATTAAATGAGCTATGCACGTGATGTGATTCTGTTGACCTAAAATGGAGACCAGTGTTTGTCT
AATGGAGTGTAATGGTTACAGACACAGGCTCTAGTGCTAGGCTATGTGTTCAAATCTTAGCTCAGTTATTTTTA
GCTGTCTGGCCCTTTCATAAGTTATTTTGCCATACTGAGCCTTGGTTCCCCATCTGAGAAGTTGAAATTTAAAAA
AATCCCTCTTACTGTGTCATCATAAGGACTAACTAATTGAAGGTGCCCTGGAGTGCAATGCCTGCATGTGGTTGG
AGCACACCATAAATGGCAGCTGCAGAGCTAGACATATCTTGGGGAGTTTGAATAAGTGGGGTTAATATGTAGACT
AGTTTCTCTGTTCTCACTTTGGGGGAAAAACCAACTAGCGTTTCCATTATTCTAATCTACTTCTCTTATGGACT
AGAATAGTTAAAATTAACAAAATGCCTTGTTAGGAGTAAAATGGGAGCTTGGATTCTCTTTATTATTTGTTTTCT
GGACTGGGGTTTCCTGTTGGAGTTCTGGGCTGGTTTCAAAGTCCCAGATGCTGGGCAGAATAAGAAGAGGTCTTC
CCTCAGGGTTGGCATCATTTACTTCATTGAAGTGAAATAGCGTGTATCAGAGCAAGTGGAACCGACACCCAAAAT
ATGACTTGAAGAATGTAATTTAAAATGTAGCATAGA

FIGURE 416

LARMLQGALLNKINVGNFVSSSQFLHFFSHRSYLPAQRWSVFQGSILGHSTGECLLTHNLGSHLKS

FIGURE 417

GTCTGAACCTCTGCCAGTCCTGGAGACTGGTGCCCTGAGCTCCAACCAGCGGGCCTCATCCTACACCCTCACCAC
CGCAACTTCTCACCCGAGCAAGAAGCAGCTCCCAGAGAGAAAGAACGTTCCCACCTGCCTAGCCATGGAGAGGA
CGCTGCACAGGCCGAAAAGTTCCAGCACCCTGGGTCTGACATGCGGCAGGAAAAGCCCTCGAGCCCCAGCCCGAT
GCCTTCCTCCACACCAAGCCCCAGCCTGAACCTAGGGAACACAGAGGAGGCCATCCGGGACAACTCACAGGTGAA
CGCAGTCACGGTGCTCACGCTCCTGGACAAGCTGGTGAACATGCTAGACGCTGTGCAGGAGAACCAGCACAAGAT
GGAGCAGCGACAGATCAGTTTGGAGGGCTCCGTGAAGGGCATCCAGAATGACCTCACCAAGCTCTCCAAGTACCA
GGCCTCCACCAGCAACACGGTGAGCAAGCTGCTGGAGAAGTCCCGCAAGGTCAGCGCCCACACGCGCGCGGTCAA
AGAGCGCATGGATAGGCAGTGCGCACAGGTGAAGCGGCTGGAGAACAACCACGCCCAGCTCCTCCGACGCAACCA
TTTCAAAGTGCTCATCTTCCAGGAGGAAAATGAGATCCCTGCCAGCGTGTTTGTGAAACAGCCCGTTTCCGGTGC
CGTGGAAGGGAAGGAGGAGCTTCCGGATGAAAACAAATCCCTGGAGGAAACCCTGCACACCGTGGACCTCTCCTC
AGATGATGATTTGCCCCACGATGAGGAGGCCCTGGAAGACAGTGCCGAGGAAAAGGTGGAAGAAAGTAGGGCAGA
GAAAATAAAAAGATCCAGCCTGAAGAAAGTGGATAGCCTCAAGAAAGCATTTCTCGCCAGAACATCGAGAAAAA
GATGAACAAGCTGGGGACAAAGATCGTATCTGTAGAGAGGAGAGAGAAGATTAAGAAATCTCTCACGTCAAATCA
CCAGAAAATATCCTCAGGAAAAAGCTCCCCCTTCAAGGTTTCTCCCCTCACTTTCGGGCGGAAGAAAGTCCGAGA
GGGAGAAAGCCATGCAGAAAATGAGACCAAGTCAGAAGACCTGCCTAGCAGTGAGCAGATGCCAAATGACCAGGA
AGAGGAGTCCTTTGCAGAGGGTCATTCCGAAGCGTCCCTCGCCAGCGCTCTGGTGGAAGGGGAAATTGCAGAGGA
GGCTGCTGAGAAGGCGACCTCCAGGGGAGTAACTCGGGGATGGACAGCAACATCGACTTGACTATTGTGGAAGA
TGAAGAGGAGGAGTCAGTGGCCCTGGAACAGGCACAGAAGGTACGCTATGAGGGTAGCTACGCGCTAACATCCGA
GGAGGCGGAGCGCTCCGATGGGGACCCCGTGCAGCCCGCCGTGCTCCAGGTGCACCAGACCTCCTGAGCTTAGAG
CCACCGTGCCATCCTGTGCTGTGCTCAAGCGGGCAGCCAGGGCTGAAGAACAAACTCTTGCACATCTCCAGCACG
ACTCACCCACTCCTGCGTTCCTGTCCAGGCAGTAATCATTGACCATATAGTCATAGTAAGACACACGAGACCAGG
CTTTACCATGAAAGCGACCTGTCACGGACTCCACTTTTAATTTGCTCTTAGGTTCTATCTCTGTAGAATGTCTCC
AAGATTGAAGAAGAAACTGAGCAGTTGAAAAATGCTAATCTCTTTGACTTAGTCAGAAAAAAACAGAGGATAATT
AAGATACTAGTCATGAAAAGTGATTCATTCTTTTTGTCATTCCATAAGCTTGCTGAATAGTGTACCGGTAATAT
ATTGTATTTCCACCGTACTCTGTGAATCTAATTATTATTCTTTAAGTGTTGATATATAATATACATAAATATGTA
AGCTAAACATATAACTATATGTTTTAAGAAGAAAACATCTACGAAAGGTAAAAAGAGATGATCAGTTGGTTGTTT
ACTTGCTAGAAACCATTGTTTTATTGCAAACGAAGGAAAAATGAAGAGATTATAAAAGTCAGCTAATGAAGTAAG
ATACGTAGTAAAGTCAGGACTATTCAAAAAGTAAGAAAGAAAATTTGGAAAATGAGAGAAACAGGAAACAAAGAA
TGCCGAAAAGAATGAAAACAGAGAAAAAATGTATGTGCTTGAAAGTAAAATACTTACAATAGTAGCTTAACTATT
TCACTCTTTAAATAAAAATACTAAAGAAGTTCGTATATCCTGGAATAACATGTCATCTTCAAAATATTTTTATTT
TCTAATATTTTAATAATAAACATTTTATAGTGTTAAAGCTGTATTTTCTTAATAAATAAAGGACATTACAAAT
AAAAAAAAAAAAAAA

FIGURE 418

MGEDAAQAEKFQHPGSDMRQEKPSSPSPMPSSTPSPSLNLGNTEEAIRDNSQVNAVTVLTLLDKLVNMLDAVQEN
QHKMEQRQISLEGSVKGIQNDLTKLSKYQASTSNTVSKLLEKSRKVSAHTRAVKERMDRQCAQVKRLENNHAQLL
RRNHFKVLIFQEENEIPASVFVKQPVSGAVEGKEELPDENKSLEETLHTVDLSSDDDLPHDEEALEDSAEEKVEE
SRAEKIKRSSLKKVDSLKKAFSRQNIEKKMNKLGTKIVSVERREKIKKSLTSNHQKISSGKSSPFKVSPLTFGRK
KVREGESHAENETKSEDLPSSEQMPNDQEEESFAEGHSEASLASALVEGEIAEEAAEKATSRGSNSGMDSNIDLT
IVEDEEEESVALEQAQKVRYEGSYALTSEEAERSDGDPVQPAVLQVHQTS

FIGURE 419A

```
GTCGGCGTCCGAGGCGGTTGGTGTCGGAGAATTTGTTAAGCGGGACTCCAGGCAATTATTTCCAGTCAGAGAAGG
AAACCAGTGCCTGGCATTCTCACCATCTTTCTACCTACCATGATCAAGTGCTTGTCAGTTGAAGTACAAGCCAAA
TTGCGTTCTGGTTTGGCCATAAGCTCCTTGGGCCAATGTGTTGAGGAACTTGCCCTCAACAGTATTGATGCTGAA
GCAAAATGTGTGGCTGTCAGGGTGAATATGGAAACCTTCCAAGTTCAAGTGATAGACAATGGATTTGGGATGGGG
AGTGATGATGTAGAGAAAGTGGGAAATCGTTATTTCACCAGTAAATGCCACTCGGTACAGGACTTGGAGAATCCA
AGGTTTATGGTTTCCGAGGAGAGGCCTTGGCAAATATTGCTGACATGGCCAGTGCTGTGGAAATTTCGTCCAAG
AAAAACAGGACAATGAAAACTTTTGTGAAACTGTTTCAGAGTGGAAAAGCCCTGAAAGCTTGTGAAGCTGATGTG
ACTAGAGCAAGCGCTGGGACTACTGTAACAGTGTATAACCTATTTTACCAGCTTCCTGTAAGGAGGAAATGCATG
GACCCTAGACTGGAGTTTGAGAAGGTTAGGCAGAGAATAGAAGCTCTCTCACTCATGCACCCTTCCATTTCTTTC
TCTTTGAGAAATGATGTTTCTGGTTCCATGGTTCTTCAGCTCCCTAAAACCAAAGACGTATGTTCCCGATTTTGT
CAAATTTATGGATTGGGAAAGTCCCAAAAGCTAAGAGAAATAAGTTTTAAATATAAAGAGTTTGAGCTTAGTGGC
TATATCAGCTCTGAAGCACATTACAACAAGAATATGCAGTTTTTGTTTGTGAACAAAAGACTAGTTTTAAGGACA
AAGCTACATAAACTCATTGACTTTTTATTAAGGAAAGAAAGTATTATATGCAAGCCAAAGAATGGTCCCACCAGT
AGGCAAATGAATTCAAGTCTTCGGCACCGGTCTACCCCAGAACTCTATGGCATATATGTAATTAATGTGCAGTGC
CAATTCTGTGAGTATGATGTGTGCATGGAGCCAGCCAAAACTCTGATTGAATTTCAGAACTGGGACACTCTCTTG
TTTTGCATTCAGGAAGGAGTGAAAATGTTTTTAAAGCAAGAAAAATTATTTGTGGAATTATCAGGTGAGGATATT
AAGGAATTTAGTGAAGATAATGGTTTTAGTTTATTTGATGCTACTCTTCAGAAGCGTGTGACTTCCGATGAGAGG
AGCAATTTCCAGGAAGCATGTAATAATATTTTAGATTCCTATGAGATGTTTAATTTGCAGTCAAAAGCTGTGAAA
AGAAAAACTACTGCAGAAAACGTAAACACACAGAGTTCTAGGGATTCAGAAGCTACCAGAAAAAATACAAATGAT
GCATTTTTGTACATTTATGAATCAGGTGGTCCAGGCCATAGCAAAATGACAGAGCCATCTTTACAAAACAAAGAC
AGCTCTTGCTCAGAATCAAAGATGTTAGAACAAGAGACAATTGTAGCATCAGAAGCTGGTGAAAATGAGAAACAT
AAAAAATCTTTCCTGGAACGTAGCTCTTTAGAAAATCCGTGTGGAACCAGTTTAGAAATGTTTTAAGCCCTTTT
CAGACACCATGTCACTTTGAGGAGAGTGGGCAGGATCTAGAAATATGGAAAGAAAGTACTACTGTTAATGGCATG
GCTGCCAACATCTTGAAAAATAATAGAATTCAGAATCAACCAAAGAGATTTAAAGATGCTACTGAAGTGGGATGC
CAGCCTCTGCCTTTTGCAACAACATTATGGGGAGTACATAGTGCTCAGACAGAGAAAGAGAAAAAAAAAGAATCT
AGCAATTGTGGAAGAAGAAATGTTTTTAGTTATGGGCGAGTTAAATTATGTTCCACTGGCTTTATAACTCATGTA
GTACAAAATGAAAAAACTAAATCAACTGAAACAGAACATTCATTAAAAATTATGTTAGACCTGGTCCCACACGT
GCCCAAGAAACATTTGGAAATAGAACACGTCATTCAGTTGAAACTCCAGACATCAAAGATTTAGCCAGCACTTTA
AGTAAAGAATCTGGTCAATTGCCCAACAAAAAAAATTGCAGAACGAATATAAGTTATGGGCTAGAGAATGAACCT
ACAGCAACTTATACAATGTTTTCTGCTTTTCAGGAAGGTAGCAAAAAATCACAAACAGATTGCATATTATCTGAT
ACATCCCCCTCTTTCCCCTGGTATAGACACGTTTCCAATGATAGTAGGAAAACAGATAAATTAATTGGTTTCTCC
AAACCAATCGTCCGTAAGAAGCTAAGCTTGAGTTCACAGCTAGGATCTTTAGAGAAGTTTAAGAGGCAATATGGG
AAGGTTGAAAATCCTCTGGATACAGAAGTAGAGGAAAGTAATGGAGTCACTACCAATCTCAGTCTTCAAGTTGAA
CCTGACATTCTGCTGAAGGACAAGAACCGCTTAGAGAACTCTGATGTTTGTAAAATCACTACTATGGAGCATAGT
GATTCAGATAGTAGTTGTCAACCAGCAAGCCACATCCTTGACTCAGAGAAGTTTCCATTCTCCAAGGATGAAGAT
TGTTTAGAACAACAGATGCCTAGTTTGAGAGAAAGTCCTATGACCCTGAAGGAGTTATCTCTCTTAATAGAAAA
CCTTTGGACCTTGAGAAGTCATCTGAATCACTAGCCTCTAAATTATCCAGACTGAAGGGTTCCGAAAGAGAAACT
CAAACAATGGGGATGATGAGTCGTTTTAATGAACTTCCAAATTCAGATTCCAGTAGGAAAGACAGCAAGTTGTGC
AGTGTGTTAACACAAGATTTTGTATGTTATTTAACAACAAGCATGAAAAAACAGAGAATGGTGTCATCCCAACA
TCAGATTCTGCCACACAGGATAATTCCTTTAATAAAAATAGTAAAACACATTCTAACAGCAATACAACAGAGAAC
TGTGTGATATCAGAAACTCCTTTGGTATTGCCCTATAATAATTCTAAAGTTACCGGTAAAGATTCAGATGTTCTT
ATCAGAGCCTCAGAACAACAGATAGGAAGTCTTGACTCTCCCAGTGGAATGTTAATGAATCCGGTAGAAGATGCC
ACAGGTGACCAAAATGGAATTTGTTTTCAGAGTGAGGAATCTAAAGCAAGAGCTTGTTCTGAAACTGAAGAGTCA
AACACGTGTTGTTCAGATTGGCAGCGGCATTTCGATGTAGCCCTGGGAAGAATGGTTTATGTCAACAAAATGACT
GGACTCAGCACATTCATTGCCCCAACTGAGGACATTCAGGCTGCTTGTACTAAAGACCTGACAACTGTGGCTGTG
GATGTTGTACTTGAGAATGGGTCTCAGTACAGGTGTCAACCTTTTAGAAGCGACCTTGTTCTTCCTTTCCTTCCG
AGAGCTCGAGCAGAGAGGACTGTGATGAGACAGGATAACAGAGATACTGTGGATGATACTGTTAGTAGCGAATCG
CTTCAGTCTTTGTTCTCAGAATGGGACAATCCAGTATTTGCCCGTTATCCAGAGGTTGCTGTTGATGTAAGCAGT
```

FIGURE 419B

```
GGCCAGGCTGAGAGCTTAGCAGTTAAAATTCACAACATCTTGTATCCCTATCGTTTCACCAAAGGAATGATTCAT
TCAATGCAGGTTCTCCAGCAAGTAGATAACAAGTTTATTGCCTGTTTGATGAGCACTAAGACTGAAGAGAATGGC
GAGGCAGATTCCTACGAGAAGCAACAGGCACAAGGCTCTGGTCGGAAAAAATTACTGTCTTCTACTCTAATTCCT
CCGCTAGAGATAACAGTGACAGAGGAACAAAGGAGACTCTTATGGTGTTACCACAAAAATCTGGAAGATCTGGGC
CTTGAATTTGTATTTCCAGACACTAGTGATTCTCTGGTCCTTGTGGGAAAAGTACCACTATGTTTTGTGGAAAGA
GAAGCCAATGAACTTCGGAGAGGAAGATCTACTGTGACCAAGAGTATTGTGGAGGAATTTATCCGAGAACAACTG
GAGCTACTCCAGACCACCGGAGGCATCCAAGGGACATTGCCACTGACTGTCCAGAAGGTGTTGGCATCCCAAGCC
TGCCATGGGGCCATTAAGTTTAATGATGGCCTGAGCTTACAGGAAAGTTGCCGCCTTATTGAAGCTCTGTCCTCA
TGCCAGCTGCCATTCCAGTGTGCTCACGGGAGACCTTCTATGCTGCCGTTAGCTGACATAGACCACTTGGAACAG
GAAAAACAGATTAAACCCAACCTCACTAAACTTCGCAAAATGGCCCAGGCCTGGCGTCTCTTTGGAAAAGCAGAG
TGTGATACAAGGCAGAGCCTGCAGCAGTCCATGCCTCCCTGTGAGCCACCATGAGAACAGAATCACTGGTCTAAA
AGGAACAAAGGGATGTTCACTGTATGCCTCTGAGCAGAGAGCAGCAGCAGCAGGTACCAGCACGGCCCTGACTGA
ATCAGCCCAGTGTCCCTGAGCAGCTTAGACAGCAGGGCTCTCTGTATCAGTCTTTCTTGAGCAGATGATTCCCCT
AGTTGAGTAGCCAGATGAAATTCAAGCCTAAAGACAATTCATTCATTTGCATCCATGGGCACAGAAGGTTGCTAT
ATAGTATCTACCTTTTGCTACTTATTTAATGATAAAATTTAATGACAGTTTAAAAAAAAAAAAAAAAAAAATTAT
TTGAAGGGGTGGGTGATTTTTGTTTTTGTACAGTTTTTTTTCAAGCTTCACATTTGCGTGTATCTAATTCAGCTG
ATGCTCAAGTCCAAGGGGTAGTCTGCCTTCCCAGGCTGCCCCCAGGGTTTCTGCACTGGTCCCCTCTTTTCCCTT
CAGTCTTCTTCACTTCCCTT
```

FIGURE 420

MIKCLSVEVQAKLRSGLAISSLGQCVEELALNSIDAEAKCVAVRVNMETFQVQVIDNGFGMGSDDVEKVGNRYFT
SKCHSVQDLENPRFYGFRGEALANIADMASAVEISSKKNRTMKTFVKLFQSGKALKACEADVTRASAGTTVTVYN
LFYQLPVRRKCMDPRLEFEKVRQRIEALSLMHPSISFSLRNDVSGSMVLQLPKTKDVCSRFCQIYGLGKSQKLRE
ISFKYKEFELSGYISSEAHYNKNMQFLFVNKRLVLRTKLHKLIDFLLRKESIICKPKNGPTSRQMNSSLRHRSTP
ELYGIYVINVQCQFCEYDVCMEPAKTLIEFQNWDTLLFCIQEGVKMFLKQEKLFVELSGEDIKEFSEDNGFSLFD
ATLQKRVTSDERSNFQEACNNILDSYEMFNLQSKAVKRKTTAENVNTQSSRDSEATRKNTNDAFLYIYESGGPGH
SKMTEPSLQNKDSSCSESKMLEQETIVASEAGENEKHKKSFLERSSLENPCGTSLEMFLSPFQTPCHFEESGQDL
EIWKESTTVNGMAANILKNNRIQNQPKRFKDATEVGCQPLPFATTLWGVHSAQTEKEKKKESSNCGRRNVFSYGR
VKLCSTGFITHVVQNEKTKSTETEHSFKNYVRPGPTRAQETFGNRTRHSVETPDIKDLASTLSKESGQLPNKKNC
RTNISYGLENEPTATYTMFSAFQEGSKKSQTDCILSDTSPSFPWYRHVSNDSRKTDKLIGFSKPIVRKKLSLSSQ
LGSLEKFKRQYGKVENPLDTEVEESNGVTTNLSLQVEPDILLKDKNRLENSDVCKITTMEHSDSDSSCQPASHIL
DSEKFPFSKDEDCLEQQMPSLRESPMTLKELSLFNRKPLDLEKSSESLASKLSRLKGSERETQTMGMMSRFNELP
NSDSSRKDSKLCSVLTQDFCMLFNNKHEKTENGVIPTSDSATQDNSFNKNSKTHSNSNTTENCVISETPLVLPYN
NSKVTGKDSDVLIRASEQQIGSLDSPSGMLMNPVEDATGDQNGICFQSEESKARACSETEESNTCCSDWQRHFDV
ALGRMVYVNKMTGLSTFIAPTEDIQAACTKDLTTVAVDVVLENGSQYRCQPFRSDLVLPFLPRARAERTVMRQDN
RDTVDDTVSSESLQSLFSEWDNPVFARYPEVAVDVSSGQAESLAVKIHNILYPYRFTKGMIHSMQVLQQVDNKFI
ACLMSTKTEENGEADSYEKQQAQGSGRKKLLSSTLIPPLEITVTEEQRRLLWCYHKNLEDLGLEFVFPDTSDSLV
LVGKVPLCFVEREANELRRGRSTVTKSIVEEFIREQLELLQTTGGIQGTLPLTVQKVLASQACHGAIKFNDGLSL
QESCRLIEALSSCQLPFQCAHGRPSMLPLADIDHLEQEKQIKPNLTKLRKMAQAWRLFGKAECDTRQSLQQSMPP
CEPP

FIGURE 421

```
TGTTTATTTGCCTGTGTCTCCTGTTAGACTGTGAATTCCTTGATGGTAGGGATGGTGTTTGCCTTGTTTAGTGTT
GAGTCCCTAATGTCTAGTCCTGTACCTGCTCCACGTAGTAGGATCTTAGTAAATATTTGTTCTGTAAATGAATGA
AACTGTGGAGCTGAAATTCAGGTCTGTTCAATTCTAGCCTTCCACTATCCCAGGTGAACAATGCAAGACCAAGTG
AGATAGGTTCTGTGAGTGGGAGGCCAGGAGTTTGCTGTGAAATTCCACGGAAAGAACAGACATACTATATGGGGG
GTTGAAGGAGGGAGCTTGTGAGCTTGATCTTGAAAGATGAGCAGAATTTTAAGAATAAGCAAAAGGGAACCACAT
AACTGACAAAGCAGGTGTGAGTGAGCATGACTTACTTGGAGAGTGGTTAGGTCAGGGTTGTTGGGGGAGTGGTGG
CAGATAAGGGAAATAAGAGAGGGCATGATAATGGGAAGATGAAGTCTAATTTGGGACCAGATTATAAAAGGCCTT
TATTTTATGCTTAGTATCTTGGGTTTTATTTTGTAGGCAATGGGGATTCTATAACTTTTTAAGAAAAATCTTTTT
ATTATAAAACACAGATATTGAAAACCACATAAAATAAATGTATAGCTTAATGAACTCTTATAGGCTTAACTCTTG
TGCAACCCCGCCCAAGTTGAGAAGTAGTTCTTTCCAGCCATCCCAGAAGTCCATCCAGGTGTTTTGTCCTAATTA
CAACTTCCTTCCACAAAAGCAAACACTATCCTGACTTTTATAGTGTTTCTTCATAGTTTATCTACCACATGTGCA
GCCCCTAGATACCCTAGTTTGCTCATTAAAAAAAAAAAAAAATTGATATGTCTTTGGTATCTCTTAAATTACTCAA
AAGAAACTTCCGAAAACGTAGCTGTTGAAAAACCAGACTGTTAACCTGTGGAGATTCTCCCAGTTGGGCTTTGGC
TGATTCCATATGCTGTTTATGTGTTGGACTGTTGTGTAAAGAGATGCTGCTTCTCATCTGCGATGTGGTTACCCA
GTAGTGTAGTTCATGTAGGGAAGGCAGGATAAAATTTGGATTCTGTTTGTCAGATAATGATTTGTTTCCTGCTAC
CTCCAAAGATGAGCAGTTAGGTGTTTTTTTTTTAAAGAATCATTACGGGCTGATGTTTTAACCATAGTGGGTG
TGTTCCATCTCTGTGTAATGGTTATGCCTGTTGAAGCTCAAATTATCCCATCTTGGGACAATAAGAACCTCTTCA
AGTGGGTTCCTGAGACCTTTTGGACATAATCCCATCGTCTTCTGTTATAGCCTCGGGTCGATAAGATGTCCCAA
GTTCATCTGGTGCATTTCTGTGCCCAGACCTTTAATCAGAACATTCTCC
```

MSQVHLVHFCAQTFNQNI

GTGAGACAGGGGTAGTGCGAGGCCGGGCACAGCCTTCCTGTGTGGTTTTACCGCCCAGAGAGCGTCATGGACCTG
GGGAAACCAATGAAAAGCGTGCTGGTGGTGGCTCTCCTTGTCATTTTCCAGGTATGCCTGTGTCAAGATGAGGTC
ACGGACGATTACATCGGAGACAACACCACAGTGGACTACACTTTGTTCGAGTCTTTGTGCTCCAAGAAGGACGTG
CGGAACTTTAAAGCCTGGTTCCTCCCTATCATGTACTCCATCATTTGTTTCGTGGGCCTACTGGGCAATGGGCTG
GTCGTGTTGACCTATATCTATTTCAAGAGGCTCAAGACCATGACCGATACCTACCTGCTCAACCTGGCGGTGGCA
GACATCCTCTTCCTCCTGACCCTTCCCTTCTGGGCCTACAGCGCGGCCAAGTCCTGGGTCTTCGGTGTCCACTTT
TGCAAGCTCATCTTTGCCATCTACAAGATGAGCTTCTTCAGTGGCATGCTCCTACTTCTTTGCATCAGCATTGAC
CGCTACGTGGCCATCGTCCAGGCTGTCTCAGCTCACCGCCACCGTGCCCGCGTCCTTCTCATCAGCAAGCTGTCC
TGTGTGGGCATCTGGATACTAGCCACAGTGCTCTCCATCCCAGAGCTCCTGTACAGTGACCTCCAGAGGAGCAGC
AGTGAGCAAGCGATGCGATGCTCTCTCATCACAGAGCATGTGGAGGCCTTTATCACCATCCAGGTGGCCCAGATG
GTGATCGGCTTTCTGGTCCCCCTGCTGGCCATGAGCTTCTGTTACCTTGTCATCATCCGCACCCTGCTCCAGGCA
CGCAACTTTGAGCGCAACAAGGCCATCAAGGTGATCATCGCTGTGGTCGTGGTCTTCATAGTCTTCCAGCTGCCC
TACAATGGGGTGGTCCTGGCCCAGACGGTGGCCAACTTCAACATCACCAGTAGCACCTGTGAGCTCAGTAAGCAA
CTCAACATCGCCTACGACGTCACCTACAGCCTGGCCTGCGTCCGCTGCTGCGTCAACCCTTTCTTGTACGCCTTC
ATCGGCGTCAAGTTCCGCAACGATCTCTTCAAGCTCTTCAAGGACCTGGGCTGCCTCAGCCAGGAGCAGCTCCGG
CAGTGGTCTTCCTGTCGGCACATCCGGCGCTCCTCCATGAGTGTGGAGGCCGAGACCACCACCACCTTCTCCCCA
TAGGCGACTCTTCTGCCTGGACTAGAGGGACCTCTCCCAGGGTCCCTGGGGTGGGGATAGGGAGCAGATGCAATG
ACTCAGGACATCCCCCCGCCAAAAGCTGCTCAGGGAAAAGCAGCTCTCCCCTCAGAGTGCAAGCCCTGCTCCAGA
AGTTAGCTTCACCCCAATCCCAGCTACCTCAACCAATGCCGAAAAAGACAGGGCTGATAAGCTAACACCAGACAG
ACAACACTGGGAAACAGAGGCTATTGTCCCCTAAACCAAAAACTGAAAGTGAAAGTCCAGAAACTGTTCCCACCT
GCTGGAGTGAAGGGGCCAAGGAGGGTGAGTGCAAGGGGCGTGGGAGTGGCCTGAAGAGTCCTCTGAATGAACCTT
CTGGCCTCCCACAGACTCAAATGCTCAGACCAGCTCTTCCGAAAACCAGGCCTTATCTCCAAGACCAGAGATAGT
GGGGAGACTTCTTGGCTTGGTGAGGAAAAGCGGACATCAGCTGGTCAAACAAACTCTCTGAACCCCTCCCTCCAT
CGTTTTCTTCACTGTCCTCCAAGCCAGCGGGAATGGCAGCTGCCACGCCGCCCTAAAAGCACACTCATCCCCTCA
CTTGCCGCGTCGCCCTCCCAGGCTCTCAACAGGGGAGAGTGTGGTGTTTCCTGCAGGCCAGGCCAGCTGCCTCCG
CGTGATCAAAGCCACACTCTGGGCTCCAGAGTGGGGATGACATGCACTCAGCTCTTGGCTCCACTGGGATGGGAG
GAGAGGACAAGGGAAATGTCAGGGGCGGGGAGGGTGACAGTGGCCGCCCAAGGCCACGAGCTTGTTCTTTGTTCT
TTGTCACAGGGACTGAAAACCTCTCCTCATGTTCTGCTTTCGATTCGTTAAGAGAGCAACATTTTACCCACACAC
AGATAAAGTTTTCCCTTGAGGAAACAACAGCTTTAAAAG

FIGURE 424

MDLGKPMKSVLVVALLVIFQVCLCQDEVTDDYIGDNTTVDYTLFESLCSKKDVRNFKAWFLPIMYSIICFVGLLG
NGLVVLTYIYFKRLKTMTDTYLLNLAVADILFLLTLPFWAYSAAKSWVFGVHFCKLIFAIYKMSFFSGMLLLLCI
SIDRYVAIVQAVSAHRHRARVLLISKLSCVGIWILATVLSIPELLYSDLQRSSSEQAMRCSLITEHVEAFITIQV
AQMVIGFLVPLLAMSFCYLVIIRTLLQARNFERNKAIKVIIAVVVVFIVFQLPYNGVVLAQTVANFNITSSTCEL
SKQLNIAYDVTYSLACVRCCVNPFLYAFIGVKFRNDLFKLFKDLGCLSQEQLRQWSSCRHIRRSSMSVEAETTTT
FSP

FIGURE 425

```
GCCACGGCGCGGACGCCATGCACACGGACCCTGACTACTCGGCTGCCTATGTCGTCATAGAAACTGATGCAGAAG
ATGGAATCAAGGGGTGTGGAATTACCTTCACTCTGGGAAAAGGCACTGAAGTTGTTGTCTGTGCTGTGAATGCCC
TCGCCCACCATGTGCTCAACAAGGACCTCAAGGACATTGTTGGTGACTTCAGAGGCTTCTATAGGCAGCTCACAA
GTGATGGGCAGCTCAGATGGATTGGTCCAGAAAAGGGCGTGGTGCACCTGGCGACAGCGGCCGTCCTAAACGCGG
TGTGGGACTTGTGGGCCAAGCAGGAGGGAAAGCCTGTCTGGAAGTTACTTGTGGACATGGATCCCAGGATGCTGG
TATCCTGCATAGATTTCAGGTACATCACTGATGTCCTGACTGAGGAGGATGCCCTAGAAATACTGCAGAAAGGTC
AAATTGGTAAAAAAGAAAGAGAGAAGCAAATGCTGGCACAAGGATACCCTGCTTACACGACATCGTGCGCCTGGC
TGGGGTACTCAGATGACACGTTGAAGCAGCTCTGTGCCCAGGCGCTGAAGGATGGCTGGACCAGGTTTAAAGTAA
AGGTGGGTGCTGATCTCCAGGATGACATGCGAAGATGCCAAATCATCCGAGACATGATTGGACCGGAAAAGACTT
TGATGATGGATGCCAACCAGCGCTGGGATGTGCCTGAGGCGGTGGAGTGGATGTCCAAGCTGGCCAAGTTCAAGC
CATTGTGGATTGAGGAGCCAACCTCCCCTGATGACATTCTGGGGCACGCCACCATTTCCAAGGCACTGGTCCCAT
TAGGAATTGGCATTGCCACAGGAGAACAGTGCCACAATAGAGTGATATTTAAGCAACTCCTACAGGCGAAGGCCC
TGCAGTTCCTCCAGATTGACAGTTGCAGACTGGGCAGTGTCAATGAGAACCTCTCAGTATTGCTGATGGCCAAAA
AGTTTGAAATTCCTGTTTGCCCCCATGCTGGTGGAGTTGGCCTCTGTGAACTGGTGCAGCACCTGATTATATTTG
ACTACATATCAGTTTCTGCAAGCCTTGAAAATAGGGTGTGTGAGTATGTTGACCACCTGCATGAGCATTTCAAGT
ATCCCGTGATGATCCAGCGGGCTTCCTACATGCCTCCCAAGGATCCCGGCTACTCAACAGAAATGAAGGAGGAAT
CTGTAAAGAAACACCAGTATCCAGATGGTGAAGTTTGGAAGAAACTCCTTCCTGCTCAAGAAAATTAAGTGCTCA
GCCCCAACAACTTTTTTCTTTCTGAAGTGAAAGGGCTTAAAATTTCTTGGAAATAGTTTTACAAAAATGGATTTA
AAAAATCCTACCGATCAAGATGAGTTCAGCTAGAAGTCATACCACCCTCAGGAATCAGCTAAGTAATTATTACTT
GATTCTTTTAGCAAATCAATGCACGTTATCCTACTTAATCCTTAAATAAGTTTAGATTTAACTAACCCAAAGTCC
AGGAGGATGTTCTTACAAAAATAGCTATATCAAGGGCTGGCACCTAGACATTAAACTGTACTTTGAAAATAAAAA
AAAAAAAAAAAAAAAAAAAAAAAAAAAAAAAAAAAA
```

FIGURE 426

MHTDPDYSAAYVVIETDAEDGIKGCGITFTLGKGTEVVVCAVNALAHHVLNKDLKDIVGDFRGFYRQLTSDGQLR
WIGPEKGVVHLATAAVLNAVWDLWAKQEGKPVWKLLVDMDPRMLVSCIDFRYITDVLTEEDALEILQKGQIGKKE
REKQMLAQGYPAYTTSCAWLGYSDDTLKQLCAQALKDGWTRFKVKVGADLQDDMRRCQIIRDMIGPEKTLMMDAN
QRWDVPEAVEWMSKLAKFKPLWIEEPTSPDDILGHATISKALVPLGIGIATGEQCHNRVIFKQLLQAKALQFLQI
DSCRLGSVNENLSVLLMAKKFEIPVCPHAGGVGLCELVQHLIIFDYISVSASLENRVCEYVDHLHEHFKYPVMIQ
RASYMPPKDPGYSTEMKEESVKKHQYPDGEVWKKLLPAQEN

FIGURE 427

```
AGANAATTAATGATTGGAAAGGGCAAAAGCAACATGTTTTGGGAGGAAGGATCTGATAGTTTCTTTTACAAAGT
ACATTTACAGATGCTTTAATAATGAGAAAAATTAATGGTAATCAGAATGTTTTCCAAAACAGTACACTGCAGATT
GATCATCAGTCACTGATATGTAAAGAGTGTTGCCATTAATATTATTCTAAAAAGCTCATTAAATTGGTCCCACGA
AATAATATGGCTCTAGACTATCCAGCTCATTATCATTATCCACCTAAGAGTACGTAAGAAGTATTTTATATCATG
TCTTCTTTGGCCTTTTCACTGAGGGCCTGTGCCATTCTCGATGCAAATAATCTTTTCTGAATATGGGAGAATTAC
TAACAAATTTATACCTGCTCACCAGGACGCTATACATACTTGCACATGTAATTTTGCTTATAGCTTCAGAAGATT
CGTGGGCCCTTCCTTCGCCAACCATTTCATGAACCCATGAGCCCCAGATTAAGAACTCTTTCTCTTGGTTGTTGT
TAAAATATAACTACGTAGCAGGAAGAGGACCATTGTGATCCACTACCAATAGAACATTTATAGTTGAAAATGCAA
TTTGAGTTGTTTGTTCACCAGTGATGCTATGTTATGCATTTGTTTACATCTCATAACATGTGGTAAATATTTATG
CAAGATGGCTAGCAGGAC
```

FIGURE 428

XINDWKGQKQHVFGRKDLIVSFTKYIYRCFNNEKN

FIGURE 429A

CCCCCAGCAGAAGGGCGCGACGGCTGCAACATCAGCGGTTAAATTGTACAGCCTTTCATAGGCCGGTTCAATGCA
TCCGTACTAAGATTGTTAAGGCTGAGGGTCCCTAGCCTGGGGAAAAACGAAAGGAGGCAGAGGGTAGGGAGACGG
GAAGGAAGACAAGGAGGGTGTAGAAAACGGGGAGAGGAGGGGGCGGGACAGCATGGGGAAGGCCTCAGGTTTACT
GGAGAGATCGTGGCGTTCCCATAGAAACGTATCCCTCCGCCCATGACCCGCGTGTTAGTCTCTTCAGTTCCTTCC
GCGTCGTTTCTTGGCTGTTTCCGCCCAGCTCCTTTGTGCCGCGCAGAACAACGAGATGACGCATGCGCAAAGCGC
AGCGGCCGCATATATAAACGCGAACCCGGGCTCTTCCTCGTAGTGCCGCCGGGACTCTTGGCGGGTGAAGGTGTG
TGTCAGCTTTTGCGTCACTCGAGCCCTGGGCGCTGCTTGCTAAAGAGCCGAGCACGCGGGTCTGTCATCATGTCG
CGTTACGGGCGGTACGGAGGAGGTAAGAAGCTGGAGTCCGGTGAGGGACGTTGGTGTGGGTGTAGTGAGCACTGC
GAGGCCGTAGGGTTGTCGCGGAGGTTGGGAGACGGTTATTCCGCGTGCGTAATGGCGGCTTAGGAGCACGCCAGA
CGAAGCCGGAGGCAGCGGAGGCGGGGTGCTGAAGGGAGACGGGATGGCGGGTGTACATCTCTGCCGAGTTCCGTA
CTCTTGGGCATTTTTGTGGCCCAATCCAGCCTAAAGCAGGGTTGAGATGACGGTTTTCGCGTTGCCTTTCTCGGA
GCTGCCCGCCGGCCCCCCTCCCCCCCCGCCCTCGGCCGGCGGCTGCCATTTTGCGCACATTGAGGACCGTGGTGG
CGCATTTCCTCAGCGCTTTCCCGCCACTTCAGCGGACAGATCTGGCCGCAGCTGTAAGATCGTGGTTGTGTTTGA
GATAGAACGAAATTGGCAGCTGTGAGCTGCATGTTCTCGTCAAACAATCGGTTAAATTGCGGAATGGGAATGGGG
ACGTAATCTGCGACTGGCGGCTGGGTTTTTTTTAGTTATTTCCAGCGCGGTTTATGGCTCTGGGCGGGGAGCT
GGAGTCTTGGGCGAGCCTGTGCCTGGGACGTTTGCCGCGGAGGACGAGAGCCGGCGCAGCCCTGCTCTCCTGGCC
CGGCCCCTACCGAGGCCCTCCCGCCGCCGACGCGCTGCCGCTGCGGGCCCGCGCGCTCCCGGTGCGCCCGGGGCT
GCCGGGACTCATGGGTGGGGCCGGGCCAGGTCCCGCCCCACGCCTCGGTGTATCCTACCACGCGTTTCTGCTTGT
GTTCGGGAGGGTCACCCCGCATTATTTAGAACGTTAAGAATTTTGTCAAAAGTCTAGTTTCTCGGGGATTTGCGG
ACTTCACCAGTTTTACGACTAAGTTTTGTCTTGGATAGAGGGCATTAAATGTGCTTTACCCAATCTTGAGGATGG
CCCGTTTTAAGGCAAGTAAGTAATTGAAACTTGGGCCAGATTTTGCATAACGTGCATTCTTCTATTTGCGTTTTT
AAACAGAAACCAAGGTGTATGTTGGTAACCTGGGAACTGGCGCTGGCAAAGGAGAGTTAGAAAGGGCTTTCAGTT
ATTATGGTCCTTTAAGAACTGTATGGATTGCGAGAAATCCTCCAGGATTTGCCTTTGTGGAATTCGAAGATCCTA
GAGATGCAGAAGATGCAGTACGAGGACTGGATGGAAAGTAAGTAAGATGTTATGAATCTTCTGTTCATTAAAATA
TACTGTGGCTAGATAATGAACTTAGTGCTAAATTTGGATTCTGAAGTCTGGAAGAGACCTTAAATAGCTGGTCAT
AGTGTTAAATGCTAAAGGCACACGAAGGTTAAAGAAGATAGCGGAGATGGAGTTAGGGCTTGGTAAAGACCGCCA
AAGTTTGTTGGGGGGGAAGGAGTGGTTGGAAAGAGTGAGTGGTTGGAAAGAGTTCTTTTTAAATCTATAAGTCCT
GAATATATTTTTAACTTTAGAATTTTGTTAATTTGCTTTTATTAGGGTGATTTGTGGCTCCCGAGTGAGGGTTGA
ACTATCGACAGGCATGCCTCGGAGATCACGTTTTGATAGACCACCTGCCCGACGTCCCTTTGATCCAAATGATAG
ATGCTATGAGTGTGGCGAAAAGGGACATTATGCTTATGATTGTCATCGTTACAGCCGGCGAAGAAGAAGCAGGTA
TTTATTTTAATAAAGGAATGGTTGGTATTCTAGTTAATCAAGTAATTCTTTTATTAGCAAGGCAGAAACTAGTGT
TTTTCTATAAACTTGAATGTTAATTGTACAGGTGTATTTTACAATTTGTGTTTAATTAAAAAAAATGTTACTATAT
TAATAATCAACCTGGTCAAAACCTTTCAGGTTTCTTCGTTTGAGTCAGTCGCCTTGATTCAGAATGTCACGAGCC
TTATGATATCATGCTGAGGCGCCTTGCAAATCCGACAATTAAGATCCTCCTAGACCTTGAGGTGATCAGCATAAG
AGGCCAGATCCCCTCGAGTCATCTACACCTAGCTTCACCTTATTCTTTAAAGGGCAGAAAATTTGAGACGGTGAT
CGCCGTAACAGTAAATTTGGCTTACAATTGGGGCCCCCCTCCGGTTTAGAAAGAGGAACACCAGATTGACCACAT
TCCCAACTAGAAAAATCTTCTTGCGTCAATCAAGCCTCACCTGGCTCATTTGGCTGTCAGTTTGATCGTCGTTAG
ATTGAAGAAAACATCTAGATGCAGCGATCGGCTATAGATACTTCTAGATCGTCTAGATCTACTAGACCATGGGCC
AAAGAGGGTCGACCTGCAAACTTGCAAGGTTTATGTTAAATACACATTACAGTGTTTATATTATGTAATGCTAA
GTTGTAATTCAGCTTTTAACAAATCTTTTTTAGGTAGTAAAAAAAAAAATACTCAACAACTAATAGGCCCAGAG
TTTATTTCCAAATGAGACACTAAATTTAAATAGTTTTGAGATTTGATTTCAGCAGAGGCACACAAACTCTTAAAA
ACGAGTTATTGTCTGACATTTTGTTTTTCTCTAACTTGAAAAATAGGTCACGGTCTAGATCACATTCTCGATCC
AGAGGAAGGCGATACTCTCGCTCACGCAGCAGGAGCAGGGACGAAGGTGAGATCTTGTTTAACTGAAGTCTTTC
TGTATTATTATTAAATTCACTGGTAGTCCAACACAGAAAAAGCTCATTATTTTTTTGGAGACAGGGTCTTGCTC
TGTCACCCGGCTGGAGTACAGGGGCATAACCACGACTCACTGCTGCCTTGATGATCTCTTGGGTTTAAGCAGTT
CTCCTACCTCAGCCTCCCGAGTAGCTGGGACTGTAGGCACTGCCACCATACCCAGCTAATTTTTATTTTTGTAGA
AATGGTCTTGCACTGTTTCCCAGGCTGGTCTCAAGCTCCTGGGCTCAAACGATCCTCCCGCAGTGCTGGGATTAT
GGGCATGAGCCACTGCACCGTTCCCCAGTTGAAGTCTTAACAGGCCAAAAAAAAAAAAAACTGTGGAGATGGACT

FIGURE 429B

```
TAAAGTTCTTTATTTTAGGTCAAGGTCAGCATCTCCTCGACGATCAAGATCTATCTCTCTTCGTAGATCAAGATC
AGCTTCACTCAGAAGATCTAGGTCTGGTTCTATAAAAGGATCGAGGTATTTCCAGTATGTAACACTTTTTTTCCT
TACTTGTGTTTGGATTGTTCACATCTTATCAGTAGAGTGTCTTAAGGACATAATTCAAATGGATTGCTTCAGGGA
ATATTTGAGATGTAAAAGTTTGGAATTTATGTGTAACTTGTAACATAAATATTACCCTAGTTTCACAGATGAAGA
AAAGGGCTACTAGAGATTTTAAGGCTTGTTAGGCCGTGTGGTAGACAAGGGTCCCAAGCAATACAGCTCTACTCA
ACACTCTGGGTAGGCATGTTGCTATAAACTTTTCTGGCTTCAGATTGGATGATACTAGCTCTGAAAGATGGTAAT
TGATTTTCCCGACAAAAAGGCCTATTAGCACCAGGAAAAGAGATCAGAAGCAAGTAGAAACATTTCTCATTTTTG
GAATGATGGGGTTGATTTGAGACACTGGAAAGTTGACTAGGGCAGTAGTGTGTACACAGAAATGAATGTGGATTT
TTTTTTTAGACCGTTTCAGACCTGAAAAAACTAAAGAACCAGAGCTTTACTATTTGTAGAAGGCCTTAAAAGGAG
ATAGAATGGAAAAAATTGTAAAATAAGTATTGCAACATGTAATTAACAATATTGTTATCTGTACCAACGATAAAA
CCGTGGTACGGAATGCTACTGGGAGTTAAATTGCTGTTTAATAGCACAAAACCTTTAAATGCAGGAATTCTGAAT
CTTGTGGTCTATTTGAGAAAGCTATGAACCATCTCTTTAGATAAATTTAAAAGATAGATATGTCAGTCTGATTTG
GTTTGTCTGACAGATTGATGGCTCTCAAACATAACTTGATCCGGGAAGAAGCCTGACAAATGGGGGCGGCTTTC
TTTTCGTCTGGCCTTATCACCTGAATTAGTCTCAGTTCAGGGGTCTGGTTATTTTCATCCTGCCTTAGCCTCCTG
AGTAGCTGGGACTGCCATTGTGTACCACAGTGCCCAGCTGAGGGATCTGTGCCTTAAGTGAGGTTAGTTTTGCTT
CCTTCATACCAGTCTCATCAAATGAAACCATGTATTTCCCTTGGATATTACACAGTGTTTGAGAATGTTATACC
TGTACAGAAACTAACCAATTGAGTGATAGAAACAAGTAATTGAAATGGGGGTTCCTTATGTCTGGTAACACTTTG
TTTGACAGTGTGTTAGACAGAATAAGGCAAGTGTTGCATCTTGTTTAGTTTTAGCTTCTTTATGCCTGACCAACC
TAATACAGTGTTGAGTAGTTAAGGAAATTCCTTTGGACTGATTGATATAATTGTGTTTTTCACTTTTTTTATTA
AGATCCCCGTCGAGGTCAAGATCAAGATCCAGGTCTATTTCACGACCAAGAAGCAGGTAGGGTAAAAATTTGATT
ATCCTTTTCTAGTTATATGGCACCAATATCCAAAGAGTTCAAAGTGTTTTAATTGTTGAAATTTTAAGTGTTAA
CTCTAAACTTAGGTTTTAGTGGGAACACAGTACCTTATTTGTGTATGTCCTATTTATTACTGGCTGACTTTCCCT
GAACAAGGGAATGTAAAACTATAGTGAGAAAGAAGCTTATGACTTGGGGGATTATATTAAAGAGGCCCTTGTTAG
AACTGATAGGTGCATGGAGAAGCATCCTGAAATCGATGTGCTTAAAGCAGAATGTAAAAGATTAATCATGATGTA
GTAATTGAGTCATTTTTTGAAAAACAGTTGTTGAAAGATTGGCTTTTGTTAGCAACAACTGGTAGGATGTTTTTC
AGTTTAAGTGCAGTCTGACATTTTAAGCTTAGGACATTTGGGGGTTTTACGGTATTGGTGACTACAAGAAAGGGA
TTGGTTAGTACTCTTTCTTTAATAGAATTTCTCATGTTTTGACAGCCGATCAAAGTCCAGATCTCCATCTCCAAA
AAGAAGGTAAGCTAAATGTTTTGTTGCCAAATCTTGCCTGTCAAGTGTGGCCTCTGCAGAATTTGTTTGCTTACT
GCTTTGCAGTCTTTGAGCTCTTTGGAGAATTGGTGCTATATAGATTAAAATACTATGCTAAGTTTCTGAAATACT
TTTTTTTTTGATTCAGTAACATTAGTTTATACTTTTGCTGGAAATACTTAGTCATAAAATGTTAGGGTGATTAT
TAAGATGTGATTGGTCCTGTGAGTACTTGGTAGAAATTTTGGTAAGATAGATGCCTTTTCCCCACATGTACAATA
GATACAAAGTGTGGAGAAAAGTCTTGGAAATAGTTACCTGCCTAGTGCTTCTTTATGACCAGAAAACTTCAAATA
GTTGTCATATTTATCTAGTGCTTCTTAATGACCAGAAGACTTCAAATAGTTGTCATATTTAACTGCAGGTTGACC
TTGCAATTTTGACAAGGAGGATAGCCTAATTTTTTTTTTTTCTGGGATGGAGTTTTCGCTCTGTCCCCAGGCTT
GGAGTGCAGTGGCTCAATCTTGGCTCACTGCAGCCTCCGATTCCCGGGTTCAAGCAATTATCCTGTCTCAGCCTC
TTGAGCAGTTGGGATTACAGGCACCCACCGCCAAGCCTGGCTAATTTTTGTATTTCTAGTAGAGACGGAGTTTC
ACCATGTTGGCGAGGTTGGTCTTAAACTCCTGATCTTAGGTGATCACCTGCCTCGGCCTCTCCCAAAGTGCTGGG
GTTACAGGCGTGAGCCACCGTGCCTGGCCAGGGTAGCCTAATCTTAAGCCAGGGACAAAAGATGAATATATGTAA
GTTCATGTCATTTTTAGGTCTTTGCTATAGGAAATTAGTACCTTAGGCCACCTTTGAAGTTATTGAAAGTTAGT
ACATGTACATGAGAGTTTCAATTGACACTAATTGGATCCAAACCTAATGTTTTTCTTTTTAGTCGTTCCCCATCA
GGAAGTCCTCGCAGAAGTGCAAGTCCTGAAAGAATGGACTGAAGCTCTCAAGTTCACCCTTTAGGGAAAAGTTAT
TTTGTTTACATTATTATAAGGGATTTGTGATGTCTGTAAAGTGTAACCTAGGAAAGATAATTCAACCATCTAATC
AAAATGGATCTGGATTACTATGTAAATTCACAGCAGTAAGGATAATATAAATTTTGTTGAATGTATGAACATCAT
ATGGTCTGAAAATGTGGGTTTTTATTTGGCACATTTAAATAACATGTTTCTAACTAGATTTTGATTTGTGTTCA
ATATTAACACTTCTTAATTTGATATATTTGAGAGTCAGACATTATAATTGTTAATCCTTATTCATACATACCTAC
ATTCAGAATTGAAAGGTGTTGGTTAAGTCTTGAACATCACTATTCTATGCATAAAACTTGGCCAGGATCTTAAGG
GACTTTGAAAATTCCATCTTACCCTTGTAGCTCTGGGTAAGATGACCTGAGTCCCTTATGATACAGCCTGAATGC
ATCATGACAGATCCTTAGTTAGCTAATCCGTTTGAAGTTGGTGTTAGTAGGTATTGTATGATCAGTGGTGAAGCA
```

FIGURE 429C

AGTAGGACCACTGATGTGTCTAAATGAGCATGACAGGAACTAAACGAAACTGATTAAATGTATGAGAAATAGAAA
CTGATTTCTGGATGATCTTTATACTAATTGCAGCTTTCAGGCTACTAGGTGGCATAGTGTTAATTAGGACTCCCC
AAGATATGGGGAGTTCTACTCTCAATGGTCTTGTTTCTTTGCTTTCTACATTAGTTAACCAGTTTTATACCAAAA
AATGCATGTTTGAGGAATTGTCTGAAATTGGGACAAAACACCTTCATGTAAACCAGCTTTGCAAAATTTTCCAGC
CCAGATACTCTTCATCTATTCAAATGGATTGTCTTATTCTGAGCAAAGACCTGTTGTTAATCTTCAAGCTAGGTT
TTGCAGTTCCCAACCACAACATTCTTCTATTTTGCCAGGCTGGTGCAAAGTAATTAAAGATGTCAATCAGAAATG
TCAATGAGACTAAAGTGGTTTTGTAAATCTCAGCTATATTTAGCAACACTCCATGTAGCTAATATTTTTGGTAG
CATCTGGTAGACCTTAGAATGTTACATAGCCAGTAGGTTCTTTATTCAAATTTTAAGTATCTTAAGAATAGTAGG
GCAGTAACAGTTACTTTTGAGAGTTTTCTGGTCAAGCTTTTACCAGGCATTCTCTAGCCTTGGTACAAAAAAAAA
AAAAACCTGCTGGTTGCGCAGATACCTAGGCTTGTCCATTTTATGCATTTCAGCAAAGTCATTGGAGACTATTGC
AACTTGGGAATACTGGTCTGCATCAAGTTTAATTCGGTAGTTTGACCGCTAGTATGTTGGAAGTTATTTGGATTG
TTTTTGGAATTTTGACTGGCTGAATTATGGTTGGTATAAAGTTATGTGTATAACTGGCAGGCTTATTTATCTGTT
GCACTTGGTTAGCTTTAATTGTTCTGTATTATTTAAAGATAAGTTTACTCAACAATAAATCTGCAGAGATTGAAC
AAATAATCCTGATACTTAATTTTGGAAGTGGGAGCTC

FIGURE 430A

```
TGGGAATCCAACTGAAGAGCAGCCAGAGGAGAGCTGAAGAGAGGAGGGGGAGGCCGATGACCTGGGCTCTGGGCC
TCTGAAGGTCTGGCGTATTCTGACAGGACACAGTGAGCATCTGTAGAGGAGAGGCTTGAAATAAAGGAGGAGCAC
GAATATTCCCTGGATTTCTGGAGGCCTGCTTTAAGGCTGGCCAGTTCTGCAAGAAAGGCAAGGAGGAGGAGACTG
GCTCACACCTCTGGAGGACCCCCTTCTGTCAGCTGTGGGGCTTGACACTACTTGAACAAGAAAAGGAGGGGGAAA
CTGCACCACATAAGTGAAGATCCACCTCCAGTGGCTGCTCTGCTGGTGGTGGGGTTGCTGCTGACAACCACCCTC
AACGGGTCTGCACCCATCCAGGAAATCTCTGTCTTCCTCAAGCTTGGTTGTGCCTGTTCTACACTCTATCTGTAT
TATTGAATTACTGACTGAGACTGTGTTTGGGAAGGAGGCTGAGTGACTACTGGACTGGATATTGACTCTAACTCT
TGTTTCCAAGCTTATATCCTCAATCACCTAAAGATCAGAGTGTGAAGAAACAAACCTGTGACAGATCTGTGGTTG
AGGTTTAGACTGGGGGAGGAGTATAGTACTGGACTTTCTTTGTAACTTGTACCATGACTGGGGCAGAGATTGAGT
CTGGTGCCCAGGTCAAGCCTGAAAAGAAGCCTGGGGAAGAGGTTGTAGGTGGGGCTGAGATAGAGAATGATGTCC
CTCTGGTGGTCAGACCCAAGGTTAGGACCCAGGCCCAGATAATGCCTGGGGCAAGGCCCAAGAATAAGTCCAAGG
TTATGCCTGGAGCAAGCACCAAAGTTGAGACAAGTGCAGTGGGTGGGGCACGCCCTAAGAGTAAGGCCAAGGCAA
TACCTGTTTCACGATTTAAGGAAGAAGCCCAGATGTGGGCTCAGCCCAGGTTGGTGCTGAAAGATTGTCTAAGA
CAGAGAGAAACTCCCAGACCAATATCATAGCCTCTCCACTTGTCAGTACTGATTCTGTCTTGGTTGCTAAAACAA
AGTACCTGTCTGAGGATAGAGAACTGGTTAATACAGACACTGAGAGCTTTCCTAGAAGGAAGGCCCATTACCAAG
CAGGATTCCAGCCTTCTTTTAGGTCAAAGGAGGAGACCAATATGGGGTCCTGGTGCTGTCCTAGGCCTACATCCA
AACAAGAAGCCTCTCCTAATTCTGATTTCAAATGGGTAGACAAATCTGTGAGTTCCTTGTTCTGGAGTGGAGATG
AGGTCACTGCAAAATTTCATCCTGGGAATAGGGTAAAAGACAGTAACAGATCCATGCACATGGCCAATCAAGAGG
CTAATACCATGTCTAGGTCCCAAACTAACCAGGAGCTCTATATTGCATCTAGTTCTGGTTCTGAGGATGAGTCTG
TTAAGACACCCTGGTTCTGGGCCAGAGATAAAACCAATACCTGGTCTGGGCCCAGGGAAGATCCCAATAGCAGGT
CCAGGTTTAGGTCTAAGAAAGAAGTCTATGTTGAATCAAGTTCTGGATCTGAGCATGAAGACCATTTGGAGTCCT
GGTTTGGGGCTGGAAAGGAGGGCAAATTCAGGTCCAAAATGAGAGCTGGGAAGGAGGCCAATAACAGGGCCAGGC
ACAGGGCCAAGCGAGAAGCTTGCATTGATTTCATGCCTGGGTCTATAGATGTAATTAAAAAAGAGTCCTGTTTCT
GGCCTGAAGAAAATGCTAATACCTTTTCAAGGCCCATGATCAAGAAAGAGGCCAGGGCCAGAGCAATGACAAAGG
AAGAGGCCAAAACCAAGGCCCGAGCCAGGGCCAAGCAAGAAGCCAGGTCAGAGGAGGAAGCCCTCATTGGGACCT
GGTTCTGGGCTACAGACGAGTCCAGCATGGCAGATGAAGCCAGCATAGAGTCCAGTCTACAAGTGGAGGATGAGT
CCATAATTGGGAGTTGGTTCTGGACTGAAGAAGAGGCCAGTATGGGGACTGGGGCTAGCAGTAAATCCAGACCAA
GGACTGATGGGGAGCGTATTGGTGATTCCTTATTTGGGGCTAGGGAAAAGACCAGTATGAAAACTGGGGCTGAGG
CCACCTCTGAATCTATACTAGCAGCTGATGATGAACAGGTCATTATTGGTTCCTGGTTCTGGGCTGGTGAAGAGG
TCAACCAAGAGGCTGAGGAAGAGACCATTTTTGGGTCGTGGTTCTGGGTCATTGATGCGGCCAGTGTGGAATCTG
GTGTTGGGGTCAGCTGTGAGTCCAGGACAAGGTCTGAGGAAGAAGAGGTCATTGGTCCCTGGTTTTGGTCTGGAG
AACAAGTTGATATAGAGGCTGGAATCGGAGAAGAGGCCAGGCCAGGAGCTGAAGAAGAGACAATATTCGGGTCCT
GGTTTTGGGCTGAAAACCAGACCTATATGGATTGTAGGGCTGAAACTAGCTGTGACACCATGCAAGGGGCTGAGG
AGGAGGAGCCCATTATTGGGTCCTGGTTTTGGACCAGAGTAGAAGCTTGTGTGGAGGGTGATGTCAACAGCAAGT
CTAGCCTGGAGGACAAGGAAGAGGCCATGATACCATGTTTTGGAGCCAAAGAAGAGGTCAGTATGAAGCATGGGA
CTGGTGTCAGATGCAGATTTATGGCAGGGGCTGAGGAGACCAATAATAAGTCTTGCTTCTGGGCAGAAAAAGAAC
CCTGTATGTATCCTGCCGGTGGAGGAAGTTGGAAGTCTAGGCCAGAGGAGGAAGAGGACATTGTCAATTCGTGGT
TCTGGTCCAGAAAATACACAAAGCCAGAGGCCATTATAGGGTCCTGGTTATGGGCTACAGAAGAGAGTAATATAG
ATGGGACTGGAGAAAAGGCCAAGTTACTGACTGAAGAGGAGACCATAATCAATTCCTGGTTCTGGAAAGAAGATG
AAGCCATTTCAGAGGCTACTGACAGAGAAGAGTCCAGGCCAGAAGCTGAGGAGGGGACATTGTTGGTTCTTGGT
TCTGGGCTGGAGAAGAGGACAGACTAGAGCCAGCTGCTGAGACTAGAGAAGAAGACAGGCTAGCAGCTGAGAAAG
AAGGTATTGTTGGGTCCTGGTTTGGGGCCAGAGAAGAGACCATTAGAAGAGAGGCTGGGTCTTGCAGCAAATCCA
GTCCTAAAGCTGAAGAGGAAGAAGTCATTATTGGGTCCTGGTTCTGGGAAGAAGAGGCCAGTCCGGAGGCAGTGG
CAGGAGTCGGCTTTGAGTCAAAGCCTGGGACTGAGGAGGAAGAAATCACTGTTGGGTCCTGGTTCTGGCCTGAAG
AAGAAGCCAGTATACAGGCTGGATCTCAGGCAGTAGAGGAAATGGAGTCAGAGACTGAAGAGGAAACCATTTTTG
GGTCCTGGTTCTGGGATGGAAAAGAAGTCAGTGAAGAAGCAGGACCATGCTGTGTATCCAAGCCAGAGGATGATG
AAGAGATGATTGTTGAGTCCTGGTTCTGGTCTAGAGACAAAGCCATTAAGGAAACTGGAACTGTGGCCACCTGTG
AGTCCAAGCCAGAAAATGAGGAAGGGGCCATTGTTGGGTCTTGGTTTGAGGCTGAAGATGAGGTAGATAACAGGA
```

FIGURE 430B

```
CTGACAATGGAAGCAACTGTGGGTCCAGGACATTAGCTGATGAAGATGAGGCCATAGTGGGGTCCTGGTTCTGGG
CAGGAGATGAGGCCCATTTTGAATCAAATCCTAGCCCCGTGTTCAGGGCCATTTGCAGGTCCACGTGTTCAGTTG
AACAGGAGCCTGATCCTTCACGCAGGCCTCAGAGTTGGGAGGAGGTCACTGTTCAGTTCAAGCCTGGTCCATGGG
GTAGGGTCGGCTTCCCATCTATAAGCCCCTTTAGATTTCCGAAAGAGGCAGCATCTTTATTCTGTGAAATGTTTG
GGGGCAAACCCAGGAACATGGTACTTAGCCCAGAAGGGGAAGATCAGGAATCTTTGCTTCAGCCTGATCAGCCTA
GTCCTGAGTTCCCATTTCAGTATGATCCTTCCTACAGGTCAGTCCAGGAAATTCGAGAGCATCTTAGGGCCAAGG
AGAGTACAGAGCCTGAGAGTTCATCCTGTAACTGCATACAATGTGAGCTGAAAATTGGTTCTGAAGAGTTTGAAG
AACTCCTTTTATTAATGGAAAAAATTCGGGATCCTTTTATTCATGAAATATCTAAAATCGCAATGGGTATGAGAA
GTGCTTCTCAATTTACCCGAGATTTCATTCGAGATTCAGGTGTTGTCTCACTTATTGAAACCTTGCTTAATTATC
CGTCCTCCCGAGTTAGAACAAGTTTTTTGGAAAATATGATTCGCATGGCCCCACCTTATCCGAATCTAAACATAA
TTCAGACATACATATGTAAAGTGTGTGAGGAAACCCTTGCTTATAGCGTGGATTCCCCGGAACAGCTGTCTGGAA
TAAGGATGATTAGACATCTCACTACTACTACTGACTATCACACACTGGTTGCCAATTATATGTCTGGGTTTCTCT
CCTTATTAGCTACAGGCAATGCCAAAACAAGGTTTCATGTTTTGAAAATGCTACTGAATTTGTCTGAAAATCTTT
TCATGACAAAAGAACTACTCAGTGCTGAAGCAGTGTCAGAATTTATAGGCCTCTTTAACAGGGAAGAGACAAATG
ACAATATTCAAATTGTTCTTGCAATATTTGAGAATATTGGCAACAATATCAAAAAAGAAACAGTGTTCTCTGATG
ATGATTTCAATATTGAGCCGCTTATTTCTGCATTCCACAAAGTTGAGAAATTTGCTAAGGAACTGCAAGGCAAAA
CAGACAATCAAAATGACCCTGAAGGGGACCAAGAAAATTAGTAATGGTTAATTGCTGGCCTCAGATTGTCCTTAT
GTTCCTGAGTTATGATCCTTGAGTAATGCTTTGATTTTAATAGTTGGTTCTGTGTTGCAACATATATCTTTAGTG
CTGACACTAACTTTGTCCAACTCTGTCTGTAAGCTGGAGCATTTTTCTGATGCCAGCTGAATATTAGAGCTGAAA
ACACATTTGTTGATATTTGTCTTGTCCACATTGTGATGTTCAGTATTTGAGCTTATAGTGAACTGAGCAATCATA
AATAAGCCACCCTTCTGATTGTCGTTCTACTGTATATATATATATATTTGAGTGTTGTTTGTGTTTCAATAAAGT
CCTATGTTAAAGTTG
```

FIGURE 431

```
MTGAEIESGAQVKPEKKPGEEVVGGAEIENDVPLVVRPKVRTQAQIMPGARPKNKSKVMPGASTKVETSAVGGAR
PKSKAKAIPVSRFKEEAQMWAQPRFGAERLSKTERNSQTNIIASPLVSTDSVLVAKTKYLSEDRELVNTDTESFP
RRKAHYQAGFQPSFRSKEETNMGSWCCPRPTSKQEASPNSDFKWVDKSVSSLFWSGDEVTAKFHPGNRVKDSNRS
MHMANQEANTMSRSQTNQELYIASSSGSEDESVKTPWFWARDKTNTWSGPREDPNSRSRFRSKKEVYVESSSGSE
HEDHLESWFGAGKEGKFRSKMRAGKEANNRARHRAKREACIDFMPGSIDVIKKESCFWPEENANTFSRPMIKKEA
RARAMTKEEAKTKARARAKQEARSEEEALIGTWFWATDESSMADEASIESSLQVEDESIIGSWFWTEEEASMGTG
ASSKSRPRTDGERIGDSLFGAREKTSMKTGAEATSESILAADDEQVIIGSWFWAGEEVNQEAEEETIFGSWFWVI
DAASVESGVGVSCESRTRSEEEEVIGPWFWSGEQVDIEAGIGEEARPGAEEETIFGSWFWAENQTYMDCRAETSC
DTMQGAEEEEPIIGSWFWTRVEACVEGDVNSKSSLEDKEEAMIPCFGAKEEVSMKHGTGVRCRFMAGAEETNNKS
CFWAEKEPCMYPAGGGSWKSRPEEEEDIVNSWFWSRKYTKPEAIIGSWLWATEESNIDGTGEKAKLLTEEETIIN
SWFWKEDEAISEATDREESRPEAEEGDIVGSWFWAGEEDRLEPAAETREEDRLAAEKEGIVGSWFGAREETIRRE
AGSCSKSSPKAEEEEVIIGSWFWEEEASPEAVAGVGFESKPGTEEEEITVGSWFWPEEEASIQAGSQAVEEMESE
TEEETIFGSWFWDGKEVSEEAGPCCVSKPEDDEEMIVESWFWSRDKAIKETGTVATCESKPENEEGAIVGSWFEA
EDEVDNRTDNGSNCGSRTLADEDEAIVGSWFWAGDEAHFESNPSPVFRAICRSTCSVEQEPDPSRRPQSWEEVTV
QFKPGPWGRVGFPSISPFRFPKEAASLFCEMFGGKPRNMVLSPEGEDQESLLQPDQPSPEFPFQYDPSYRSVQEI
REHLRAKESTEPESSSCNCIQCELKIGSEEFEELLLLMEKIRDPFIHEISKIAMGMRSASQFTRDFIRDSGVVSL
IETLLNYPSSRVRTSFLENMIRMAPPYPNLNIIQTYICKVCEETLAYSVDSPEQLSGIRMIRHLTTTTDYHTLVA
NYMSGFLSLLATGNAKTRFHVLKMLLNLSENLFMTKELLSAEAVSEFIGLFNREETNDNIQIVLAIFENIGNNIK
KETVFSDDDFNIEPLISAFHKVEKFAKELQGKTDNQNDPEGDQEN
```

FIGURE 432

```
CGTTTTCTGGGTTTTTGTTATTTTTTAGTGGTAACACAAGCCTATAGGGCATTTATAGCCACCTATTATACTGTT
TCCATAAGCCTGGCTACCTTTTAGGGAAGCTATTTTTTCTCTTTCATTTTTACTGTCACAGCACATACACACACA
CCTTTTTGTTTTAAAGGATTAAGTACTGTTTGAAGATCAGTGGTAACAGAAAATTTGGGAGGGAGAAGAAGAAAT
TAAGACATGACTTGTTAGAAAATTAAGACTTCAGTTTCTAGAATTATCTTTTCATCAAGATTTGGTAGACATTGA
GTTTAAATGGAAAGGAAATTATTTAAGCCTGTGTATGTTAGATCCACAATACACCATTGGTATTGAAATATAAAG
GTTAAAAAAAAGGCTTATGACCTCTTTAATGAGATAAATATGTATTTGTCTTGTAAGCAGGCAGAAAATCTACCT
CTAATTTTAACACTAATACTTTGAAACCCACAATCAAATAGAGTGAATTCTCCAAGTTACATAAGCAAGGAAAAC
ATTATTTGAAATATGCCATGTTTTCGTTGCCTTTGGACACCTCATCATTCAACTCTAATTTTACCGAGTCCCGGG
ATTTGTACTGTCCCATTGTACTTGCAATCTACAATTTATATAATAGAAAAACAACCAAACCCATTCATACAAGGA
TCTGAAGTTATAAGGTTAAGGGCAGAAAGTTTCCCATAAGTATAAAACATTTCCAGGTCATGAAGAGTAGTTTAG
GTTGAGTGACAAAAGCCTAGGTGTGGTTGTTTTTCATTCATTTGCATCTCACGACCAAGACATTTTGCTTGCAG
GGTCAATCTGCTGCTTAAAATGTACAATTAGGTATATAAAATAAGTACAATGGTGAAAACACAAAGCCAGGTAAA
GCAGCATGCCCCACTAAATTTTTCAGTATACATAGGGACAGACAAGTGAGTTTTGGTTGTATCTAAATATTTTAA
TTTCAGGTTCCTTCTGTGCCCTGGGCCACTATTTCCCAGGGGTGTGACAGAGATGCCTGCCAGATCCATATCAAC
TAGAAGTCTGATTTCTGTTGCTGCCCTTCCTCAGCAACTATGGCAGTATACTTTTATCACCAAGCACCACTCCCT
TGTCCCTGAATCACATTTTAATAGAGTACAATATCTTCTGTACAATATTTCTGAAACACTTATGTCTGAAATATA
TGCTGTATTGTATGTTAACCCATGACATATATGAACTACAAGGCTTGCATAATCAGTGAGCTAGTGGATAAATCA
AGACAGGAGCAAATGGGAGAAAGATGAATAAACAAATGAAAAAAGATGAATAAATGAATAAGAGAGATGAATAAA
CAAATTTACATTACATGTGATAGTTATCATGGTATGGCCTTCATGACAAGATGGATGAGAATATCACTGATAGGA
TATTAGCCTTCTTTCATATCTTTATATTGAAATATGGGCTTTACTTCAATTTGAAGGTCTTTCATGAACAATAAA
AGAGAGTAGAAGGACTGTCTGAGAAGGCAGGAGACATATAAAACAGATGACTGAAAGACTGACTAGCTCCTGGAA
AGGGAAACATTTGGAACATCCAGAGTAAGGGCAAATGGGCTTCTACCAGCACAACAAAGAGCCTCCAGGTGGCAA
CATGGAAGCAGGTTATCAGAGAAAATAAATGTGCAAATTCCTTATTTACAATGACTCACTTAACCCCACAAACAT
GTTTCACTGCTGCCTTCCCCAGTTGTCGCTTATGTACTGTTGTTACCTTTCAGTTACATGCCTTTGATCCTAAAA
TTCTCTACTTTTGTTGCCTTATCAGTTCTTTGCAATCTGCCTGTGGTTATCAGCACTTAAAGCACAATTTTGAAG
GGGAAAAAAATGATAATCACCTTAGTCCCAAAGAAATAATTTGTCAAACTGCCTTATTAGTATTAAAAACAGACA
CACTGAATGAAGTAGCATGATACGCATATATCCTACTCAGTATCATTGGCCTTTTATCAAATGGGGAAACTATAC
TTTTGTATTACATAGTTTTAGAAATCGAAAGTTAGAGACTCTTTATAAGTAATGTCAAGGAACAGTAATTAAAA
ACAAAGTTCTAACAAATATATTGTTTGCTTAATCACAATGCCCTCAACTTGTATTTGAATAACTAAATAGGACAT
GTCTTCCTTGGAGCTGTGGGCATTAGTTCAGAAGCACTACCTGCATCTTAATTTTCAAAACTTAAGTTTTATTAG
CAAATCCTCTTCTCTGTAAGACTTAGCTATGAAGTGGTATATTTTTTCCAAATATTTTTCTGAAAACATTGTTG
TTGTAACTGCACAATAAAAGTCCAGTTGCAATTAACTAGTGTGAGCTCTTATTTAACTGAAGCAAATGCTTTCTG
ACAGTGTGTACTTTGAATTTTTTAACAATATAAAAGACAACATTTTCTGCATTGTTAACAAATATAGAGAACAAA
AATCCATTTATACAAATAATTTCTTGGATCATTCAGGTCCAATTTAGGACCTTTAAGAGTATAAATGTAAATGTA
TCCGATATCATGGCATCTTTATTCCAGATCTGTTACTGAATTATTTGAAAGAAAATGCTTCACATAAAACAGAT
TAAGAACTGAGAAAACATAAAGCAATACCTTCTGGGCTGCCATTTCCTCATCTATGAGAAGGGTGCAGGACATGA
TCTTTAATGTCTTTTTCAGTTCCGTTGGCTTTTTATTCTTACAAACCTGAAGTTCACTTAGTTTCTAAAGAGTAT
GGGATGAAGGAGAAACTATAACAAGTTACAAAAAATTTATTTTGTTTATAAACAAAAATTACAAACAAAAAATTA
TAAATTTTGTTTGTTAATTTATAAACTTACCTTTAAAATTAAACAAAAATTACAAACAAAAAACAAAATCATAAA
TT
```

FIGURE 433

RFLGFCYFLVVTQAYRAFIATYYTVSISLATF

FIGURE 434A

```
GGGTGGATTAATTTTTTTTTTTGACGTTCTTAGAACAGTGCCTGACTTAATTCTACTTCATAGGGTTGATGTAA
TTTGAGACTTAAATAAGTTGATACTAAAATACCACTTAGTGTCCCGAACACTGTTTGACATTTAGTATCAACC
AAGTCTCAAGGTTACTTCAATCCTGTGAACTAGAGCCAAGGCACCTCCAGTGGCCTTTCAGAAGTTCCATTCCA
CTCCCGCCTCATCTCCTAATTCTATCTCCCCGTTCTCTTTACTCGAGCCCTCCTGGCCTTGCCCTTCCTTAGGCC
TGATACGCACCTATCTGAAGACCTTTGCACTGCACTCCAGCCTGGAAGGCAGAGAGAGACTCCGTTTCAAAAAAG
AAAAGAATTCTGGGTTTGAATCCTGCCTCTCCGTCTGCTAGGGATATGATTTAGGGCAAGTTGCTTGAGCTCTTT
GGGCCTCTGTTTTCACGTCTGTATGATAGAGGTGGTATTGTTTGACTTGTATTTGTGAAGTTTCAATGAGATTGA
TAATTGTCGATTTTATGTTAATCCCTAGTACATGGCCTGCTGTCAACACCCAGGACACCCAGGATATGGTCTTTG
CTGTTTGATTTTCCTCATCCCCAGTCTCAAGGGGAAGCCAGGACAATGAGAACAGCCACTTCCCATCAGGAGTCA
CTGCAAGGCCCCAGGGTGGGATGGTGGGGAGATAAGAACCGTGAGAGAAGTTGGCACAAAGGAGTTATGGGACA
AAGGGTCCAAGATAGGCAGAAAAGAAAATGTTGCCAGTTGATGGGGAAGAAAGGAAGTCGGAGGGCTCAGACACT
GAGGGGGACAGAACATCTCCATGTGCAGTCTCATCTCTTATAGTCAGCAACAGGTATCCACGGGGAGGGCCCTAC
ATCATCTGCTACCCTGAAGGATCTGGAGGTAGGAGGCTCTGGGCGGAGGTGCAGTGACCCCGCAGGCCAGCCCTC
CAACCTCCTCCCGCAGCGGGGACTGGGTGCCCCTCTGCCAGCTGAGACAGCCCACACACAACCCAGCCCTAATGA
TCGTTCTCTCTACCTCTCCCCCAAGTCCTCCTCCGCCTCCTCCTCTCTGCATGCGCCTCAGAGCCCGTGCCAAGA
ACAAGCAGCAGTCCTGAACTCGAGGTCCATAAAAATCAGTCGACTGAATGACACCATCAAATCTTTGAAACAACA
GAAGAAACAAGTGGAACATCAGCTGGAAGAAGAAAAGAAAGCAAACAATGAGAAACAGAAAGCTGAAAGGGAGCT
AGAGGGTCAAATCCAGAGATTGAACACAGAGAAAAAGAAACTAAATACGGACCTGTATCACATGAAACATTCTCT
CAGATACTTTGAAGAAGAGTCCAAGGATCTGGCCGGCCGCCTGCAACGTTCATCGCAGCGTATAGGAGAGTTAGA
GTGGTCTCTCTGTGCTGTCGCCGCCACACAGAAGAAGAAGCCGGATGGGTTCTCGAGCCGCAGTAAAGCACTTCT
CAAGCGGCAGTTAGAGCAGTCCATACGGGAGCAGATACTGCTGAAAGGACACGTGACACAGTTGAAGGAGTCGCT
TAAAGAAGTCCAGCTGGAGAGAGATCAATATGCTGAACAAATAAAAGGAGAGAGGGCCCAGTGGCAGCAGAGGAT
GAGGAAAATGTCGCAGGAGGTTTGCACATTGAAGGAGGAGAAGAAGCATGATACGCATCGGGTAGAGGAGCTGGA
GAGGAGCTTGTCCAGACTCAAAAACCAGATGGCTGAGCCACTGCCCCCGGATGCCCCAGCAGTGTCCTCTGAGGT
GGAGCTGCAAGACCTGAGGAAGGAGCTGGAGAGAGTGGCAGGAGAGCTCCAGGCTCAGGTGGAAAACAATCAGTG
CATCAGTCTCCTGAACCGTGGGCAAAAGGAGAGGCTTCGCGAGCAGGAGGAGAGGCTTCAGGAGCAGCAGGAGAG
GCTTCGGGAACAGGAGAAGAGGCTTCAGCAGCTGTCCGAGCCACAGAGCGACTTGGAGGAGCTGCACGAGAACAA
GAGCGCACTGCAGTTGGAGCAGCAAGTAAAGGAGCTGCAGGAGAAGCTGGGCCAGGTGACGGAGACGCTCACCTC
GGCTGAGAAGGAGCCAGAGGCAGCAGTCCCAGCCTCAGGGACTGGGGGCGAGTCTAGCGGCCTTATGGACCTCCT
GGAGGAGAAGGTGGACCTGAGGGAGCATGTGGAGAAACTGGAACTTGGATTCATCCAGTACCGGAGAGAGAGATG
CCATCAGAAAGTACATCGCCTTCTAACAGAGCCAGGGGACAGTGCCAAAGATGCGTCACCGGGAGGAGGCCATCA
TCAGGCTGGCCCAGGACGAGGAGGAGAGGAAGGTGAAGCTGTTGGAGCTGCAGGAGATGGTGTTGCGGCTTGTGG
CAGCTATAGCGAGGGCACGGCAAATTCCTGGCCGCTGCCCGGAACCCTGCTGCTGAACCCAGTCCAGGAGCCCC
AGCCCCCCAGGAGCTCGGGGCTGCCGACAAGCATGGTGATCTTTGTGAGGCGAGCCTCACCAACAGCGTGGAGCC
TGCACAAGGAGAAGCCAGGGAGGGTTCTTCCCAGGACAACCCTACTGCACAGCCAGTCGTGCAGCTCCTTGGTGA
GATGCAGGACCACCAGGAGCACCCAGGCTTGGGCAGCAACTGCTGTGTGCCATGCTTTTGCTGGGCTTGGCTGCC
GAGAAGAAGGAGATAAACACCACCATCATCAAAGAGCTGCTCAAGAAATTTTAAAAACGAAACAAGTTATGGG
GTTAATCTCCTACACAATTCATTTACTTCATTTGAATGTTAGAGCTACTCATGATTATTTGTGTTTCTAATTTAT
AGTTTAAGTTTATTTGTAAAAAGTTAAAAGAGAGTGGGTCTCTGTGCCTCTCACTGATGTTCACTCTGGCATCCT
TTAGCATTTTTCTTTTTTCATTTCATAATTGTAGGTCATTAGCATGCATATCGAGTTTGCCCTTACGTGGTGGGA
GTTCAAACACACAAAGACCCACTCTTTGCACAAAACTGTTCTCGCTGGTTTGGAATAGGCTCCCGTGCTTTTTA
ATGTTATTGCAGCATGGATGTTCATTACAGAATTCAGATAAAATTTGCTAATGTTCTGCTATGATGTTTGATCTC
ATCTTAATCACAGTGAGCTCTTCCATAGCTCAATATGCGGTTTGCCCTCAAGTGTGCACTGTTTATTACTTTGTA
ATATGCCACTATGAGTACTGACACTTAGAGCTGTTTAAAGGCCGAGAACTGGAAACAGCCTTTCCTCCATTTCT
GTGTATTGGTGATGGGAGTGATAACCTTTTGGGGGAGCTTTCTAAATCTCGCAGAAGAGGAAAGTGGCCTGCTCT
GGCAGGTATGTGCAGGATACAGTGTGTTTCATCTGTTCCGGTGCCAAGAATGAGCACTGTACTGTGGCAGTTCCC
TTTGGATTTGTATGTGCTCTGGGCTCATGAAGATATTGCATCGTGAGCTGCAGCAGTTGCACTCTTTTTCAGTGA
CCTAAAAATGGCTTATTTCCGAGGAATGAAAGGCTGCCATCGTTGGCTGTGGATGTGGAAAACCTTTCCTAGCTT
```

FIGURE 434B

```
AGAGCATTTGTATCTACAATACATTTTAAAGTCAGAGTTCGTGTTCCCTGTTTTAATCACATGACTACCTGTGCC
AGTACACGAAAGGGCGCTGGTTGGCATTCTTCTTAATGTATTTAGTAAAGATCATAAGACATCCTTTAAGAGTTT
AAATGTCTCTGAAACAGGCATACAGGCTCTAGTCAAGAATGAATTAGAGTGAAGGAAAGCTGTGTGACACCTGGC
ATTCCTCTCTGTTCATGGAGCTTCTTTGAGGCTTGAAGTTTGATTTTACTATCTAGACCTCTCTGGCTAATACCT
ATTCTCCAACCACCTCGGTTACTCTGACATAGGAATTTACTTCTTTTCCTTGAGTGGAAAACACTTTAGAAAATA
ATAACAAACATTATTATAAACTAATATATGTGAGAGTACTTAGTTGAAACAAAAAGGAATTTTAGTAGACAGTAT
TATATTATCTTTGAAAATCAAGGAGAAGTTTATGCAACTGAAAATGTTTACACACTGTGCTGCAATCTACTGTTT
GTGAATGTCAATGTATTATCAGGAAACATGGCTATACGATCGCAGAGTTGTATTTCCTCACAAACTTCTTTACGA
AGAGTGAAATATGTTTTTGTACCTCTCAGTTTCAGTCAGGGACATATTTTGTGCAATATTTCTGTGATTGTGCCT
ATGCGTGATGAGTGAATGCATTTCAATCATACATTGCCTAAATCATAACTTGATGATGCTTGGGAAAGAATCAAC
AGTTAAAACTTCATGAAGTTC
```

FIGURE 435

MKHSLRYFEEESKDLAGRLQRSSQRIGELEWSLCAVAATQKKKPDGFSSRSKALLKRQLEQSIREQILLKGHVTQ
LKESLKEVQLERDQYAEQIKGERAQWQQRMRKMSQEVCTLKEEKKHDTHRVEELERSLSRLKNQMAEPLPPDAPA
VSSEVELQDLRKELERVAGELQAQVENNQCISLLNRGQKERLREQEERLQEQQERLREQEKRLQQLSEPQSDLEE
LHENKSALQLEQQVKELQEKLGQVTETLTSAEKEPEAAVPASGTGGESSGLMDLLEEKVDLREHVEKLELGFIQY
RRERCHQKVHRLLTEPGDSAKDASPGGGHHQAGPGRGGEEGEAVGAAGDGVAACGSYSEGHGKFLAAARNPAAEP
SPGAPAPQELGAADKHGDLCEASLTNSVEPAQGEAREGSSQDNPTAQPVVQLLGEMQDHQEHPGLGSNCCVPCFC
WAWLPRRRR

FIGURE 436

```
CTCATTTTGCCCATGTGGGAGACTTAGCCTATTTGCCCGCCTCCACTGGGAGGGGCTTACAGAAAGAGCCATCAG
CCAGAGGGCTCCTACAGAGTCATGGGGCTTCTGCTCCCCAGGGCGCCAAGCGCCTGCTGCCTCATGGGTAGACAA
GGTTAGAGAACACATTCCAGCTAATCTGCTGGGGTGTGGATAGGAGACTTTCCGTGGAACCTTACACAGCCGAGC
CTTTGTGTTTCACTATTTCAGGATGCAAACTGAGCAAGGAACTGATACCAGGGCCAGCACGACAGCAAAACCTCC
TAATGTTTTAAAATTTAAACGGCTCACACAGAAATGAGAGTTCCAATTGATTTTATTTAAAATAAAACTATCAGG
ATGCTCTCTGATCATTTAGAAAATTTGGAAAATGCAAAAAATAATAGGAAGGGAAAAGTTTTGCATAGTCTTAC
```

FIGURE 437

SFCPCGRLSLFARLHWEGLTERAISQRAPTESWGFCSPGRQAPAASWVDKVREHIPANLLGCG

FIGURE 438A

```
CACGGAACAGCCCTCCTGGGGTCCCCACGAGCCGCGTCCTGCTGTGCCCCGGCGCCTACGCAGCAGCGGCCGCGG
CCGCGGTGGGCACGCACGGTTACCCCGGGCAGCTCCGGCCGCCAGCTGCAGCCCCGTCGCCTCGGCCGCGCCAGC
CGGCTGCGGGCACCTGGGGCGGGCTGGGGGCGCCGGCCGCGGCAGGAGGCGCTGTAGCGAGGGCTGCGGCGCCG
GTCCTGCGGCGGCCGCGGGAGGCAGCGGGGCAGGCGCTGTGGGCCGGGCTCCTCCTCCGGCTCCTGCGCGACCGC
CTCCCGCCGGGCTCTGCCGGCGCCCGCCGTCCCCGCAGCGCCGCTCTGCGCCCGCCGCCCCGAGCGCCCGCGCGG
GGCTGGCGGGAGCCTCGGCGGGCGCGCGGGCGCGCGGGGCCATGGTCGTGGCCCCCTGACGGGCCGCGGCCGCCT
CCATGAAGCGGAAAAGCGAGCGGCGGTCGAGCTGGGCCGCCGCGCCCCCCTGCTCGCGGCGCTGCTCGTCGACCT
CGCCGGGTGTGAAGAAGATCCGCAGCTCCACGCAGCAAGACCCGCGCCGCCGGGACCCCCAGGACGACGTGTACC
TGGACATCACCGATCGCCTTTGTTTTGCCATTCTCTACAGCAGACCAAAGAGTGCATCAAATGTACATTATTTCA
GCATAGATAATGAACTTGAATATGAGAACTTCTACGCAGATTTTGGACCACTCAATCTGGCAATGGTTTACAGAT
ATTGTTGCAAGATCAATAAGAAATTAAAGTCCATTACAATGTTAAGGAAGAAAATTGTTCATTTTACTGGCTCTG
ATCAGAGAAAACAAGCAAATGCTGCCTTCCTTGTTGGATGCTACATGGTTATATATTTGGGGAGAACCCCAGAAG
AAGCATATAGAATATTAATCTTTGGAGAGACATCCTATATTCCTTTCAGAGATGCTGCCTATGGAAGTTGCAATT
TCTACATTACACTTCTTGACTGTTTTCATGCAGTAAAGAAGGCAATGCAGTATGGCTTCCTTAATTTCAACTCAT
TTAACCTTGATGAATATGAACACTATGAAAAAGCAGAAAATGGAGATTTAAATTGGATAATACCAGACCGATTTA
TTGCCTTCTGTGGACCTCATTCAAGAGCCAGACTTGAAAGTGGTTACCACCAACATTCTCCTGAGACTTATATTC
AATATTTTAAGAATCACAATGTTACTACCATTATTCGTCTGAATAAAAGGATGTATGATGCCAAACGCTTTACGG
ATGCTGGCTTCGATCACCATGATCTTTTCTTTGCGGATGGCAGCACCCCTACTGATGCCATTGTCAAAGAATTCC
TAGATATCTGTGAAAATGCTGAGGGTGCCATTGCAGTACATTGCAAAGCTGGCCTTGGTCGCACGGGCACTCTGA
TAGCCTGCTACATCATGAAGCATTACAGGATGACAGCAGCCGAGACCATTGCGTGGGTCAGGATCTGCAGACCTG
GCTCGGTGATGGGCCTCAGCAGCAGTTTTGGTGATGAAGCAAACCAACCTCTGGCTGGAAGGGGACTATTTTCGT
CAGAAGTTAAAGGGGCAGGAGAATGGACAACACAGAGCAGCCTTCTCCAAACTTCTCTCTGGCGTTGATGACATT
TCCATAAATGGGGTCGAGAATCAAGATCAGCAAGAACCCGAACCGTACAGTGATGATGACGAAATCAATGGAGTG
ACACAAGGTGATAGACTTCGGGCCTTGAAAAGCAGAAGACAATCCAAAACAAACGCTATTCCTCTCACAGTAATT
CTTCAATCCAGTGTTCAGAGCTGTAAAACATCTGAACCTAACATTTCTGGCAGTGCAGGCATTACTAAAAGAACC
ACCAGATCTGCTTCAAGGAAAAGCAGTGTTAAAAGTCTCTCCATTTCAAGGACTAAAACAGTCTTGCGTTAAGTA
AAAACCTGTGACCAGAGCTGAAGGAAGACTCTAGGACTGAAAACTGCAACAGAAATTAGCACAATTTGAAAACAA
AACAAAATTGCAAAAGCCTTAGTTGCTTTTTCCACCTAAGAAGTTGATCAATGGAGAAAATGTCCACTGGAGTTT
GAATAATGAACTTTGAGTTTGGGTGCAAGCAAATGACTCAGAGAAGGGTCCAGCTCTCAAGCTGAATGACAAACA
TGCTGTTGTAAATTTAGTCTCAGGTGTAAATACCCAAGCCCTCTGGTACCCAGGGAGCTGGCTGGTCTGTGGTGC
ATGTGTGTCCCTGTGATGGCAATCATTGTAGTTGCTGGCCTTCAGAAGAATTGAGGATCTGATGGAGGTTTTTA
TGTATTTATTTTCTGTTCACCTTGTGACCCTGTGTCAAAATTTATAAAGATACAAAAGGCATTACTGAAATGGTA
CTTTCTGTAATTTGATACTATTTGGCTTAATCATCTTCACTTGACTATTTGTAATACTGTTGTAATGTTAACTCT
GTTAAGTACCCAAGCTGCTTGTCTTCCACCAAAGAGTGCTTTATTAACAAGAATCTGTGAAAATCACATTTAAAC
ACTGTTGCATGTTGTAAGACCAGGTGGTACCTTAGTAACCTAAAACTTGCAAGAGAATATTAATGGTAGCTTTAG
AAGACTCAGGAGGAGAAACTGACTTCAGAGTTGGAAGATGTTGCAAGTCGTTCCTTTTTCTGTCCTTCAGGGACT
GAAGAACTGGGAGGCTGCCCATTGTTTGGTTGCCAGTCATACAAATTAAAATCATATTTCCTTCCATGAATGGAA
GAAACACACTATTGGTTTTTCCCCTTGGAAACAGCAATCCCAAATAATGTCGGCTTACAAAAAAAAAAAGTTACC
ACTTTTTTAGAGTCCTTCCCTGTAACATTGGATTTTTTTTTTCCCTTATGAGATCCACCTAAGGCCATTGACGTG
GCCTGCGATCTCAGTGACAATGATCTGCTTCTGGATCTCACTGTTGCCTTTGGTTAGGGAACACAACTAGTAACT
CTGCAGAGTGCCTTCTCCCGCAGCCCTACTGGAACACAGCAGAGTCTGTGCCATGAAGCAGTTACAGAAACAGAA
TTGATGTGCTGCTAGAAAAAAAAAAAAAATGGGGCCCGAAATAAAAGAATATATAGTACTCACCTCAGTTCCTTC
CATAAGAAGTGGGTGGTTTAATGATTGTTAAGCCATTTTTGCCTGTGCCGGGAGCATGGAGGGCTGAGATGTCGA
CAGGCAGTGGGAAACAAATGCCCTCCTAAGCCACAAGGCGTGCGCCAGATTAGTAGGCAACTCCATTTTAAGAAG
CTGCCTTTTTCACAAAACTGGAAGAAATAAAAGCGGTTGGAATAAACAAGTTAAAAGTCTTTAATGCAAAAAGTA
ATTGAAAGGCAGTGCCTCCATTTTGGTGTACTTTCTTGGAAGAAAGTATAAAATTGACCGGCATCATGAGAGACG
GAAGATGCCGTGTTCTCAGCCAAACAAGCAACTCTTTCCCCGCCAGGCACTGTCGGGTGGGGTCAGGCCAGCTTT
TAAACACTGGGGACTGGATCACAGAAAAACAGTGGTTTTCTGTCCCTGGAAATGAATAGGCACAAAGACCCACTT
```

FIGURE 438B

```
GGCTGTGGGCAGACTACTCTTCAATAAGATTTGGGTGGGAGGAGGAACATTCCTTTTGCTATTTTGAGCTGAGAC
AATATAAATATTCAAACTGTGCCATGCATAAAGCATTGAATTCTCAGGGCACCTCTTCTTCCCCTTACCCCTTTT
AAGGCCATCCCCTCCATTAATAATAATCCAGGTAGTTGTGAAAATCGTGCTTCTATCTGATCCCTTCTTAGTTTG
GCTTTTCATCCCATCAGAACAAGTAAACGTAGGCGCCACAGCTCTTGTGAGTACTGTCTCCCTCACGGTGAATGA
GCCTCCTGGTGTTTCGTCCAAGAAAAGAAAGGGTGTCACTGGAACCACAGCCCTTTTTCATTTTATAAACTGCCT
CTTCATGTTGCCTGCTCAAGTTTCCACCTAGAATTGCTATCACTGTGGCTCTTTCTAAAAATCTTTCTATTTAAC
TGGTTCACTGAAATTAGTCATAGAAAACTTGTGATTTGGTGAAGAGGCATTCCTTGTAATAACCAAATGACTTGG
GATGGTGTGCATAGCAAGGGCAGTGTTACACTTATGAGGACTGTCTCTAGCATCCAGGAAGTCTCTGGGTCTGAG
GGATGGAAAGTTCTTCCTGCTATGAATGAGAGTGGACTCTTCCCCTCACCCCCAACTGAAACCACAAACAACCAG
AATCTTCTGGAATTCTGACTTAGAGTCGTTGTTATAGAAGACCTTGTTGCTATGGAACATGAAACTGTGTGTCAG
ATGGAGAGATCCCCTTAACCTAAGAGCCTTAAATAGCCCTGAAAGTACACTGGGACGGTTTGCGATGGAATTAAA
ATTGGAAGTGAATATTTTTAGGTGCTCTTGAAGCTTTCTGGGGACTCAAAATTATCAAAAGTCAGGGACAGTCCG
GAGGAAGAGCGTCTGCAAAACTGGGTTCCTAGAAGTATAGACGGACTTAGCTTTTGTAGAATTTGGTGAGGAGC
AGCGCCTCGTGAGAGCAGAATGGCCTGGCGTGGCCAGTGCTTCCCGGCAGCACGCAGCTCTGCGGCCTCCAGAAT
TCCCCTGTTCTGAGCTTGATGCCCCTAGCCTGTCCCTACCTACTTCCTCCCCTCCTCTCTAGCCCTCTCACAGG
GGTGATTGCTACCTCTCTGTTTCTTGGGCCTAGGCAAGTTTTAGAGGAGTTCCCAAGCATTGTTATGAGGCCAG
TGTGCTCGCTGGGCTGGGCGGGATGGCCTGGGCTTGTGTGTGGCCTGAGGGCTCTCCTGGGGCCTTCTCTTTTCC
CAGTCACCTTTGGAGCCACAGAAGCAGTGCACTCATTGGATGTCTGTTCTTAACACAGCTTCTCTTTCTACATTA
AAAAAAATCATTATTGCATTTTGGAAAGCAGTGCTCATCAAAAGCAACTTTTAAAACCTATTTTATTGTTCCTTT
AAATGTTCTCTCCCGCTGAAACTGCCCTGGAGAGGCTATCTGCTGCTCTTCCATTTACCCACATCAGGTTATTCT
CCATGTCACTCAGTGGAGATGACTCCAGATGTGTTTAAAGACTGGACAATTCACCTATACTGTGTAGGAAATTAC
CTCCTTAATTACCTGGTAGAATTGTCAGCAGACATGTTCATCCGATGATAGTACTGCAGTTTTCTATTAATAATT
TGCAGACTTTTATCTAACCTGCACTCATGTACAGATTATTAAAAGTTTTAAAATGTAACTGATCAGTATTGATCA
ATCATTGTCTTGATTTTTTTTACAGCGTATATTTCTAATCATATTTTTAAAGCCAAGAGAACTGGTTGAATGA
ATGTTTATTTTCCTGAAGGTATTTTAAGATAAAGCTTCCTAATGGCGTGTAAACTTTGCATATGTATGTAGTTT
GATACATATTGTCACATTTGAAAATCTTGTGGGTTGTAACTGGTTTTATACAAAATATCGAATAGTGGAAATTGT
ATAATTACAATCATGTAATTAAAAGTATTAACCC
```

FIGURE 439

MKRKSERRSSWAAAPPCSRRCSSTSPGVKKIRSSTQQDPRRRDPQDDVYLDITDRLCFAILYSRPKSASNVHYFS
IDNELEYENFYADFGPLNLAMVYRYCCKINKKLKSITMLRKKIVHFTGSDQRKQANAAFLVGCYMVIYLGRTPEE
AYRILIFGETSYIPFRDAAYGSCNFYITLLDCFHAVKKAMQYGFLNFNSFNLDEYEHYEKAENGDLNWIIPDRFI
AFCGPHSRARLESGYHQHSPETYIQYFKNHNVTTIIRLNKRMYDAKRFTDAGFDHHDLFFADGSTPTDAIVKEFL
DICENAEGAIAVHCKAGLGRTGTLIACYIMKHYRMTAAETIAWVRICRPGSVMGLSSSFGDEANQPLAGRGLFSS
EVKGAGEWTTQSSLLQTSLWR

FIGURE 440

ACACTTTCTTCTGACATAACAGTGTTCACTAGCAACCTCAAACAGACACCATGGTGCATCTGACTCCTGAGGAGA
AGACTGCTGTCAATGCCCTGTGGGGCAAAGTGAACGTGGATGCAGTTGGTGGTGAGGCCCTGGGCAGATTACTGG
TGGTCTACCCTTGGACCCAGAGGTTCTTTGAGTCCTTTGGGGATCTGTCCTCTCCTGATGCTGTTATGGGCAACC
CTAAGGTGAAGGCTCATGGCAAGAAGGTGCTAGGTGCCTTTAGTGATGGCCTGGCTCACCTGGACAACCTCAAGG
GCACTTTTTCTCAGCTGAGTGAGCTGCACTGTGACAAGCTGCACGTGGATCCTGAGAACTTCAGGCTCTTGGGCA
ATGTGCTGGTGTGTGTGCTGGCCCGCAACTTTGGCAAGGAATTCACCCCACAAATGCAGGCTGCCTATCAGAAGG
TGGTGGCTGGTGTGGCTAATGCCCTGGCTCACAAGTACCATTGAGATCCTGGACTGTTTCCTGATAACCATAAGA
AGACCCTATTTCCCTAGATTCTATTTTCTGAACTTGGGAACACAATGCCTACTTCAAGGGTATGGCTTCTGCCTA
ATAAAGAATGTTCAGCTCAACTTC

FIGURE 441

MVHLTPEEKTAVNALWGKVNVDAVGGEALGRLLVVYPWTQRFFESFGDLSSPDAVMGNPKVKAHGKKVLGAFSDG
LAHLDNLKGTFSQLSELHCDKLHVDPENFRLLGNVLVCVLARNFGKEFTPQMQAAYQKVVAGVANALAHKYH

FIGURE 442A

GCGGCCGCCGCCCTCGCCACCCCGCCTGCCCACTCCCGCCGCCGCCCCGCTCTCGCTTTCCCCCCGGCCTCCCCT
CGCCCCTTCCCCTCCCCCTTCCCGGCGCACTCGGGGGGCTGGGAACGAGCTGCCATGTGATGCGCGTCCCCTCCG
CGAGCTTTCGGTGACCCACGAACTGCCCACCTCGCCGGCTGCCGGGAGGGGGCTGCGAGCCGGGAAGACGCGGGG
AAGAGGAGGCGGAAAAGGACGCAAAGTTCTCCGGCGAGCGCATTCATTCACATAGCTCCCAGTTTTAACATTTCG
CCACCTACTGAAGACATCATTTGGGACCAAGCTGATGAGCCCTTGAAGCACAGCAGATAAGAGTGTTGCTGTTGA
TCATCTTTGCCTGGGAAGTTGAATGATAAAGCCAGAAGAAAGCATGCTTTCTGATCATTTGCAGCTGTCTGCTTC
AGAAAGTGAGGGCTCCAGGAATGAGGAGAATCTTCAAGAACTTCCTCGCACTGTGACATGTCTGATCCCTTGCTC
CCATCCCTGCAGCATGAACAAGGTGGACACTCACTGACCTGTCACAAGGTTGCCCCACAAAACTTTGGGGTCCAT
GTCTGAATGGATTGCCAGAGCCTTCTCATCTCTCCCTTCGCCCAGTTCCCTGCATCCTAAGACTCGAAGGCAGCA
CAGGACCTGGAAAAATTACATGGTGTGAACGGCATGTCTGTGGATGAGAAGCCTGACTCCCCCATGTATGTGTAT
GAGTCCACAGTCCACTGCACCAACATCCTCCTGGGCCTCAATGACCAGCGGAAAAAGGATATTCTCTGTGACGTG
ACTTTGATCGTGGAGAGGAAGGAGTTCCGGGCCCACCGGGCTGTGCTGGCCGCATGCAGTGAATATTTTGGCAG
GCGCTGGTTGGACAGACAAAAAATGATTTGGTGGTCAGCTTGCCTGAGGAGGTCACAGCCAGGGGCTTTGGGCCG
CTGTTACAGTTTGCCTACACTGCCAAGCTGTTACTCAGCAGAGAAAACATCCGCGAGGTCATCCGCTGTGCTGAG
TTCCTGCGCATGCACAACCTGGAGGACTCCTGCTTCAGCTTCCTGCAGACCCAGCTCCTGAACAGTGAGGATGGC
CTGTTTGTGTGCCGGAAGGATGCTGCGTGCCAGCGCCCACACGAGGACTGCGAGAACTCTGCAGGAGAGGAGGAG
GATGAAGAGGAGGAGĀCGATGGATTCAGAGACGGCCAAGATGGCTTGCCCCAGGGACCAGATGCTTCCAGAGCCC
ATCAGCTTTGAGGCCGCCGCCATCCCCGTAGCAGAGAAGGAAGAAGCCCTGCTGCCCGAGCCTGACGTGCCCACA
GACACCAAGGAGAGCTCAGAAAAGGACGCGTTAACGCAGTACCCCAGATACAAGAAATACCAGCTTGCATGTACC
AAGAATGTCTATAATGCATCATCACACAGTACCTCAGGTTTTGCAAGCACATTCCGGGAAGATAACTCTAGCAAC
AGCCTCAAGCCGGGGCTTGCCAGGGGGCAGATTAAAAGTGAGCCGCCCAGTGAAGAGAATGAGGAAGAGAGCATC
ACGCTCTGCCTGTCTGGAGATGAGCCTGACGCCAAGGACAGAGCGGGGGATGTCGAGATGGACCGGAAACAGCCC
AGCCCTGCCCCTACCCCCACGGCCCCAGCTGGGGCCGCCTGCCTGGAGAGATCCAGGAGCGTGGCCTCGCCCTCC
TGCTTAAGGTCTCTGTTCAGCATAACGAAAAGTGTGGAGCTGTCTGGCCTGCCCAGTACATCTCAGCAGCACTTT
GCCAGGAGTCCAGCCTGCCCTTTTGACAAGGGGATCACTCAGGGTGACCTTAAAACTGACTACACCCCTTTCACA
GGGAATTATGGACAGCCCCACGTGGGCCAGAAGGAGGTGTCCAACTTCACCATGGGGTCGCCCCTCAGGGGGCCT
GGGTTGGAGGCTCTCTGTAAACAGGAGGGAGAGCTGGACCGGAGGAGCGTGATCTTCTCCTCCAGCGCTTGTGAC
CAAGTGAGCACCTCGGTGCATTCTTATTCTGGGGTGAGCAGTTTGGACAAAGACCTCTCTGAGCCGGTGCCAAAG
GGTCTGTGGGTGGGAGCCGGCCAGTCCCTCCCCAGCTCGCAGGCCTACTCCCACGGTGGGCTGATGGCCGACCAC
TTGCCAGGAAGGATGCGGCCCAACACCAGCTGCCCGGTGCCAATCAAAGTCTGCCCTCGCTCACCCCCCTTGGAG
ACCAGGACCAGGACTTCCAGCTCCTGCTCTTCCTATTCCTACGCGGAGGACGGGAGCGGGGCTCACCCTGCAGC
CTCCCTCTCTGTGAGTTCTCCTCCTCGCCCTGTTCCCAGGGAGCCAGATTCCTTGCCACAGAACATCAGGAACCA
GGCCTGATGGGAGATGGAATGTACAACCAAGTGCGGCCCCAAATTAAATGTGAGCAGTCTTATGGAACCAACTCC
AGTGACGAATCCGGĀTCGTTCTCGGAAGCAGACAGTGAGTCGTGTCCTGTGCAGGACAGGGGCCAGGAGGTAAAA
CTTCCTTTTCCTGTAGATCAAATCACAGATCTTCCAAGGAACGATTTCCAGATGATGATTAAAATGCACAAGCTA
ACCTCAGAACAGTTAGAGTTTATTCATGATGTCCGACGGCGCAGCAAGAACCGCATCGCGGCCCAGCGCTGCCGC
AAAAGGAAACTGGACTGTATTCAGAATTTAGAATGTGAAATCCGCAAATTGGTGTGTGAGAAAGAGAAACTGTTG
TCAGAGAGGAATCAACTGAAAGCATGCATGGGGGAACTGTTGGACAACTTCTCCTGCCTTTCCCAGGAAGTTTGC
CGAGACATCCAGAGCCCCGAGCAGATCCAGGCCCTGCATCGGTATTGCCCTGTCCTCAGACCCATGGACTTGCCC
ACGGCCTCCAGTATTAACCCTGCGCCCTTGGGTGCTGAGCAGAACATTGCGGCCTCCCAATGCGCAGTGGGGGAA
AACGTGCCCTGCTGCTTGGAGCCAGGCGCGGCTCCCCCCGGACCCCCCTGGGCACCCAGCAACACCTCCGAGAAT
TGTACCTCTGGGAGGAGACTAGAAGGCACTGACCCGGGAACCTTCTCAGĀGAGGGACCTCCTCTTGAACCCAGG
AGCCAAACAGTGACCGTGGACTTCTGCCAGGAAATGACTGATAAGTGTACAACTGACGAACAGCCCAGGAAAGAT
TATACCTAGTGACTCGGCTCTGCCTCCCAGTCCGCACACCTCTCCCATCCAGGCGTTCTTCAGTCAGCCTGTGGC
ACTGTTCATCTGCTGTCCCGAAGAAACCGAGAACACATTTGGTGCACACTACAGCGGTCTTAGCAGCAATACTGT
TCCGAAGTATCCTCTCCTCTTCTCGAGCAGGAGTGATAGTTACCTTCACAATGGTGCTACCCCTTGCCCAGGCAA
GGAAAGACAGCAGTGATGACACTGTCTGTCTGTGGCTCAATTTCAGTCTTCACAGGGATAGACTACAACACCTCT
AGGCCCCAACCACGGATTTTTTTCTCAGTGGCCCATGTCACAAACCCTATCTCAGGAATTTCTTCTGAATGTTC

FIGURE 442B

```
AATTTTTTTCATTGAAGACAGCTTCTATACACATCAAAGTTTTATAGCTAGACTGTACATATTATATATAATATA
TATATAAAAAATATATATATATATATATATCCATATGCAAAAGTCCTGCATGCCTCAACTTTCTCATCCTAAAAC
TGGAAACTTATTTCTCATTTAGAAACAGGTTCCAACATTCCTCTTCTTTTGTCTCTGATGCTAGAACTAGTTTGG
TAACTGTTAACGTGGTCATTTTCTTGCTTCACAGTTCAATTTTCAATTCGTACTTATTTATGGACAAAATTCAG
TGTTGGAAGCTTTTTCCCAAGGTTTTATTTCAGATTTCTTTTTCGTTTGGTTTGGTTTTGGCACCTCCAAGTGGT
GTCATTTGAGCATTGTAGGTTTGTTTTTTGTTTGTTTGGGGGGTTTTGTTTGTTTTTGTTTTTGTTTTGTTTTC
CTTGCAGATACTGTACAGTAATGGTCAACTTTGCCACTTGCACTGAGTTTTGGGTCAAACCTATTTTCTTAAATG
AAGTTGTAACTTCGGTATAACTCAAGTATACTGTATATTCTTTGCTTTTAGTTAAAAAAGTAAAACATTTTAGCT
AATTAAAAAGCACTCAGGTGATAATTATGTAGGAAAAACAATCTTGCCAAATAATGAATTCATCCTAGGATGTGT
AGACAATAATCTGCTTGAATATTTTATATTTCACCTCCTCCCCACCTTTCCCTAAGCAAAGTTTAAACGCAGAT
AGAGAGTTCAGAGTTGATGCTGGATGTTCAGATTCCTAAGTGGGGAGAGAGTTTGGACATCTCACTCAAAAGTAC
ATCAGAAAAACAGGAATCCGTGATTTTATACCAGAACTCAGCAGGCATTGGCTCCTAGAAATCAAGTTAGAAAGT
TTTCACCCAGGGAGTAAGTCCCATTCATTTCAACACGTCCTGAGGCCTCGGCTTGCTCTTGGAAGTGGTGTGCAG
TAGGACCTGCTCCCCTGAAGGACGGGGCCAACCAGCCACTGGCTTTCCTGCCCAGGCTTGGCCTCCCAGGACATC
TGGCCTGAGGGGATTTGAATCACAGCCCCGAAGGTCCTGCCTTCACCCCATTGGGAGAGAGCAGGGCATCCTGGC
ATCTGCGATCCATCCCTGACACAGGCTGACACATTCTTTCTCCTTTCCTTCTCCAAAGGCTTGGAGTTTTCTTCT
GAGGTTTTTCTGCCAGTGTCTTGTCTGAAGGCAGACTTCATTCTGAGGCTTTGGACAAGCTATTCACCGGGAACC
CTCCCTGTCCCCTTCCCGAATCACACACATACCCTACCCTCACCTGATGATAATTTTCTCTTCTTGCTGCAAAAC
TGGTTGGCTTGCAACCCAGAGAGAGCAGCTTCCCTTGGCTCTGGGGCCGTGTTGGCCCCAGCCACGTTTACAGG
AAGGTGTGCCCCAGAGGAGGAGGAATCAGCTCCCTCGCTCCAGTGGCCTTGGGTCCGGGTCTCACTGAGCAGCCC
GAGGGCCACTCCAGCCCGGCTGGGGAAGAGAGTCCTGAACGGTTTGATGTGGGGATGGGGTGGTGGGCAGTGGGG
AATAGATGGTTGACTTTGTTTCTTTATTTGTGCCATTGTTTGGACAATATTAAAGCTGCATGTAAAAGGGGAAAT
TAGTATATGATGTAGGCTAAAAGTGAAATCATAGTAACATATGTTTAGTATTATTAACTTTTTTCTGTACAAAT
ATTAGCACTAAATGTTTAAATATGTATGAATGCCAGAAATTTGTCAGTTCATGCAGTAGGATAAAAAAAAAAAAA
AAAAAAAAAGGGCTTTTCTTTTAAACAGTTCCACTTTTAAAACCTGCCTCTGGGTTTTGTTTTTCTTGTTTG
TGTGTGTGTGTGTGTGTGTGTGTGTGTGTGTGTGTGTCTGAAACAGATCTTGATAAAGCTCTGTG
TTGGAGCTGCTGGTTTTGTTATGGTTGTTGGAATTTCTTGGCCTACTAGGACAGTTCTGTGCTTCACCATGAGG
TTTGCCTTTGTGGAAAACTCGTGGGTGACAGTGAGAATATAAACTCAATGTGAATCACGTGATACTTCGGCAGGC
GTGTGTTACAGTGGAGTCAGCTGACAGTATTTGCTTTTTAACTCTATTGTTGCCTTTCCAAGTGACCTCTCCTC
TTCTTTTAAAAAAAGAACACTTTCTGCTCATATCATAACCAGGTCCAACCCAGCTTCTTGGCATGAGGTTTACCC
TGGTAACAACTCATGTGCAACTGGTAGTCTTGACCACATTCCATCCATTTCCTCAGGTTTCTGTGGTTCAGTAGC
CCAGACCTGTTTGGCAGCCATTTCTAGCAGGGGCGGGGCCTCTTTATTTCTCTCCACCCTAACTCAGACCTCACC
TTCCTCCCACCCACCCCTGCCTTGCTTTTCTTCCTCTTCCCCCAACCTAACTTCTGCCATGGGAACTGGTTAAAA
ACACTGCTCTAAAAACCATCTTCCAATTTCATAGAGATTTCTCACAAGTTATTTCATTCATAATCCACCATGAAC
AGTGACTAGCTTCGTGCAGTTGTTCATGTGATGTGTGTGTGTCTTTTCCTATTCAGAACTATGTGCTTGTCAAAA
TTATTTCTGGGTTGATTCAAAGGGAGGACTTGCTGGGGACCAGAATCCAAACGGCCTCAAGTGGAATTTTAAAAC
CTAGCCTGTCTCTTTTCCCTGGGATCCCTCTGTCAACCCCACGCCTTTTAGGAAAAAGAAAAGTGAGTGAACAGC
AAGGAAGAGTGTTTGCACAGTACAGTAACATTTGGTTGTTCTTAAGGCTCTTTTCTTACAAAAATAAGAGACCCT
CCAACCACGGGCTGTTTAGGAGGATGCCTGCTTGGGTCTCCAAATGGCTGGGGTAGGAATGGTTGTTGGGGCAGA
GCCAGTGGAGGTGAGTGACCCTGAGACTAATGAACATCCCACCTAAATCCAGTCCTCCCCTTGGATCTGCCTTTG
TCCTGCTTGTGTATCCAGGCAACCTCTTTTCAAGTTGGTCAGGCTTTGGACAGGTGAGTGATTTGCTGTATGTGT
TTGTTTCTCTGCGTTACCTGGGGGTGCCTTGATTAAAATCGAACTTTATTACATACTGATTCTGGAACAAAACAG
TTAGAAAAACTTTAAACTTTAAAAAAAAAAAAAAACCGACAAAGTTACGAGGCCATCCTGCTATTTATCTTCTGAGT
TCCCAGCAATGACTCAGGCATCAGAGATGATGCTGCAGTGGAAAACCTGACTCTGTGTGTCTGCAACTGAATGTT
GTGCGAGTAATTTATTAACTGTCTTTCTAAAGGTTTGCTGCTTTTAAGATGCACTATAATTCGGGATGTAATCCT
TACATTGCTTTTCCAAGGAAGGGAACAAAAGTCTAGTGATTAGTATGCCAACTGCCACTACTCCTTCAAAAGGAG
CCAGGACCAGCGACAAGACTCATGAGAGGACTGGCTAAAGTGAAGTGTGCACAGTGTGAAGTTTAATGCTGTTGT
CAAGAGGCCTAAACCCACATTTTCTCTTTTAATATTTTATGATTGCCATCAAAGAAGAAGAAAAAGAAGGAACAG
```

FIGURE 442C

```
ACAAAGGTTTGAAAATGATAAGCCTGTTAAGACACCAAAAACTCCTGTCCCGTGAAGCTGCTTGACATCCTGTGG
AGTAGCATAATCCTCTCAAAATGAGGAAGAGCTGCCTGCAAAGCTTTCTCAAGTCCCTATTTGGCTACCTACTTC
TCTACATTATGCCCCATTTAAACTAGGAGCTGTCTTAGAAATGACTTCAAACTGCTTCACTATTGCTTACAGTTT
AGGAGGAGTCTCAGATCCAGAAGGAGCAAGAATCAAGTTTGGTCCTCAAATGACTGTAAATAGACTAAAGAACAA
GGTGTTTTTGTTTTTGTTTTTGTTTCTAAGAATAAAGCTGTTCGTTGTATCATGAGTTAGTGTTTCTTCCCCA
AACTGAAGACTGTGTTGGAAGTGCAATTTCTGGTGAGTCAGTCCACAATACAATGCCCTGTGTGGAGTTGGTATT
CATACAGGAAATCTGTGTGCACGAGGCATTGTGTGTTGAAAGTGTATGTTTATAGTACTGCCTGAGCCATCTCAT
GACCCCAGCGTCCAAAACCGATGCTGTAGAACAGAACATATCTGTCACAAATAGGTGTGTGCAAATAGCATTTGT
ACATAGAAAAGTCTCATTGTGGCAGATTGAGCATAAATTATTCAACTGACGGTGCAAAAACATTACTTGCAAAGA
AAAGTTTATAGTATTTTCCTACACTCCACCCTGGGAGATGATATTTCTATCAAATGAATATCAGTGCATTTTAAA
TGTAATATGAAAACGATGCTGCCATTTTGTGAAGAATACCCACTTGGTTGCAGAGGCCAACTTTCATAGCTTTGA
TTTAATGTTGTGACACGGTGTATGCATTTTGCTGTCAAGCAATGGATAAACAGCTCTGACTTTCATTCTCATTCC
AGTTTATTGACCTCAGATAAAACACTGGCCCTTCTTAGAAGCAGAAGTGTGCACCAAGACCATTCATTTCAGGTA
GACTCACATTCAGTGCCAAGTGCTCCCATGGGAATAATCAGACGCATATGTTGCGAAAGAGTGAAGGGACTTGGA
CAAAGAGGGGTTTTCCTACAGATGGATGCTCAGTCTTCTACCAAAACATGTTTGGAGGCAGAACTATGACCTCCC
CTTAAGTCCTAACAATGTATTTGTGTGTGCAAATCCTGGGATGCCCGTTTCACGCTCTGACATAAAGACATGGC
ACCTCTAGTGAGTGATCAGGAAGATTCCATATGCATTTGGGAGCTTCAGGTGCTTGTTAGACACAGTGAGCCATT
CAAGGCAAGCACCACCTTTGCTAGTGAGGCCAAGAGAGCCTGTGACAATTTGACAATTTGTTCCAGAACCAGTCT
GATGCAAGTGCACCTCTAATATATGCCTTACAAACTCCAGAGGCCATATTCAAAACAGGGTCTTCTCAGTGTATG
CAAGGGGCTGCAGCCCCTCTTCTCTTCCTCCCCAGGTTGAACAATACGGACAGTTTTCACACATATCTACCTGTA
TAACCCTCTGTACCTCTCATAACTGGTCAACGACTGTAACAGGTTACATCAGGTGTTTTCTACATACTTTTTAC
ACAGATTCTATGCGATTAATGTAATTTAATTCAATGCATCATTTTATTGTACTAGTTCTTAGGCTTGTCCTTATT
TTTTTCTAAGTGATTGTGGTTTTCTCGTGGTTTTATTGTAAAAAATGAAAGGCTGTTGATGCTTATTCTCTGT
AACTAAGAATTTTACCTTTTGGGGGAAAAAAGCATTGCTATGAACTAATGGAATTGGAACTTCATTTACTCATTG
TAAATACACTATTGTGCAAAAAAAGTTTTCACTCAATTGAATTGCTAGTGTTAACTGAATTTTGTCTAGACACCA
TTTCTGTTGATGAAATAAAGACATATCATTATGCATTGTAAACTG
```

FIGURE 443

```
MSVDEKPDSPMYVYESTVHCTNILLGLNDQRKKDILCDVTLIVERKEFRAHRAVLAACSEYFWQALVGQTKNDLV
VSLPEEVTARGFGPLLQFAYTAKLLLSRENIREVIRCAEFLRMHNLEDSCFSFLQTQLLNSEDGLFVCRKDAACQ
RPHEDCENSAGEEEDEEEETMDSETAKMACPRDQMLPEPISFEAAAIPVAEKEEALLPEPDVPTDTKESSEKDAL
TQYPRYKKYQLACTKNVYNASSHSTSGFASTFREDNSSNSLKPGLARGQIKSEPPSEENEEESITLCLSGDEPDA
KDRAGDVEMDRKQPSPAPTPTAPAGAACLERSRSVASPSCLRSLFSITKSVELSGLPSTSQQHFARSPACPFDKG
ITQGDLKTDYTPFTGNYGQPHVGQKEVSNFTMGSPLRGPGLEALCKQEGELDRRSVIFSSSACDQVSTSVHSYSG
VSSLDKDLSEPVPKGLWVGAGQSLPSSQAYSHGGLMADHLPGRMRPNTSCPVPIKVCPRSPPLETRTRTSSSCSS
YSYAEDGSGGSPCSLPLCEFSSSPCSQGARFLATEHQEPGLMGDGMYNQVRPQIKCEQSYGTNSSDESGSFSEAD
SESCPVQDRGQEVKLPFPVDQITDLPRNDFQMMIKMHKLTSEQLEFIHDVRRRSKNRIAAQRCRKRKLDCIQNLE
CEIRKLVCEKEKLLSERNQLKACMGELLDNFSCLSQEVCRDIQSPEQIQALHRYCPVLRPMDLPTASSINPAPLG
AEQNIAASQCAVGENVPCCLEPGAAPPGPPWAPSNTSENCTSGRRLEGTDPGTFSERGPPLEPRSQTVTVDFCQE
MTDKCTTDEQPRKDYT
```

FIGURE 444

GTTCGGGAGCCGCGGCTTATGGTGCAGACATGGCCAAGTCCAAGAACCACACCACACACAACCAGTCCCGAAAAT
GGCACAGAAATGGTATCAAGAAACCCCGATCACAAAGATACGAATCTCTTAAGGGGGTGGACCCCAAGTTCCTGA
GGAACATGCGCTTTGCCAAGAAGCACAACAAAAAGGGCCTAAAGAAGATGCAGGCCAACAATGCCAAGGCCATGA
GTGCACGTGCCGAGGCTATCAAGGCCCTCGTAAAGCCCAAGGAGGTTAAGCCCAAGATCCCAAAGGGTGTCAGCC
GCAAGCTCGATCGACTTGCCTACATTGCCCACCCCAAGCTTGGGAAGCGTGCTCGTGCCCGTATTGCCAAGGGGC
TCAGGCTGTGCCGGCCAAAGGCCAAGGCCAAGGCCAAGGCCAAGGATCAAACCAAGGCCCAGGCTGCAGCCCCAG
CTTCAGTTCCAGCTCAGGCTCCCAAACGTACCCAGGCCCCTACAAAGGCTTCAGAGTAGATATCTCTGCCAACAT
GAGGACAGAAGGACTGGTGCGACCCCCCACCCCCGCCCCTGGGCTACCATCTGCATGGGGCTGGGGTCCTCCTGT
GCTACTGGTACAAATAAACCTGAGGCAGGA

FIGURE 445

MAKSKNHTTHNQSRKWHRNGIKKPRSQRYESLKGVDPKFLRNMRFAKKHNKKGLKKMQANNAKAMSARAEAIKAL
VKPKEVKPKIPKGVSRKLDRLAYIAHPKLGKRARARIAKGLRLCRPKAKAKAKAKDQTKAQAAAPASVPAQAPKR
TQAPTKASE

FIGURE 446

```
AAGATCTAAAAACGGACATCTCCACCGTGGGTGGCTCCTTTTTCTTTTTCTTTTTTTCCCACCCTTCAGGAAGTG
GACGTTTCGTTATCTTCTGATCCTTGCACCTTCTTTTGGGGAAACGGGGCCCTTCTGCCCAGATCCCCTCTCTTT
TCTCGGAAAACAAACTACTAAGTCGGCATCCGGGGTAACTACAGTGGAGAGGGTTTCCGCGGAGACGCGCCGCCG
GACCCTCCTCTGCACTTTGGGGAGGCGTGCTCCCTCCAGAACCGGCGTTCTCCGCGCGCAAATCCCGGCGACGCG
GGGTCGCGGGGTGGCCGCCGGGGCAGCCTCGTCTAGCGCGCGCCGCGCAGACGCCCCGGAGTCGCCAGCTACCG
CAGCCCTCGCCGCCCAGTGCCCTTCGGCCTCGGGCGGGCGCCTGCGTCGGTCTCCGCGAAGCGGGAAAGCGCGG
CGGCCGCCGGGATTCGGGCGCCGCGGCAGCTGCTCCGGCTGCCGGCCGGCGGCCCCGCGCTCGCCCGCCCCGCTT
CCGCCCGCTGTCCTGCTGCACGAACCCTTCCAACTCTCCTTTCCTCCCCCACCCTTGAGTTACCCTCTGTCTTT
CCTGCTGTTGCGCGGGTGCTCCCACAGCGGAGCGGAGATTACAGAGCCGCCGGGATGCCCCAACTCTCCGGAGGA
GGTGGCGGCGGCGGGGGGGACCCGGAACTCTGCGCCACGGACGAGATGATCCCCTTCAAGGACGAGGGCGATCCT
CAGAAGGAAAAGATCTTCGCCGAGATCAGTCATCCCGAAGAGGAAGGCGATTTAGCTGACATCAAGTCTTCCTTG
GTGAACGAGTCTGAAATCATCCCGGCCAGCAACGGACACGAGGTGGCCAGACAAGCACAAACCTCTCAGGAGCCC
TACCACGACAAGGCCAGAGAACACCCCGATGACGGAAAGCATCCAGATGGAGGCCTCTACAACAAGGGACCCTCC
TACTCGAGTTATTCCGGGTACATAATGATGCCAAATATGAATAACGACCCATACATGTCAAATGGATCTCTTTCT
CCACCCATCCCGAGAACATCAAATAAAGTGCCCGTGGTGCAGCCATCCCATGCGGTCCATCCTCTCACCCCCCTC
ATCACTTACAGTGACGAGCACTTTTCTCCAGGATCACACCCGTCACACATCCCATCAGATGTCAACTCCAAACAA
GGCATGTCCAGACATCCTCCAGCTCCTGATATCCCTACTTTTTATCCCTTGTCTCCGGGTGGTGTTGGACAGATC
ACCCCACCTCTTGGCTGGCAAGGTCAGCCTGTATATCCCATCACGGGTGGATTCAGGCAACCCTACCCATCCTCA
CTGTCAGTCGACACTTCCATGTCCAGGTTTTCCCATCATATGATTCCCGGTCCTCCTGGTCCCCACACAACTGGC
ATCCCTCATCCAGCTATTGTAACACCTCAGGTCAAACAGGAACATCCCCACACTGACAGTGACCTAATGCACGTG
AAGCCTCAGCATGAACAGAGAAAGGAGCAGGAGCCAAAAAGACCTCACATTAAGAAGCCTCTGAATGCTTTTATG
TTATACATGAAAGAAATGAGAGCGAATGTCGTTGCTGAGTGTACTCTAAAAGAAAGTGCAGCTATCAACCAGATT
CTTGGCAGAAGGTGGCATGCCCTCTCCCGTGAAGAGCAGGCTAAATATTATGAATTAGCACGGAAAGAAAGACAG
CTACATATGCAGCTTTATCCAGGCTGGTCTGCAAGAGACAATTATGGTAAGAAAAGAAGAGGAAGAGAGAGAAA
CTACAGGAATCTGCATCAGGTACAGGTCCAAGAATGACAGCTGCCTACATCTGAAACATGGTGGAAAACGAAGCT
CATTCCCAACGTGCAAAGCCAAGGCAGCGACCCCAGGACCTCTTCTGGAGATGGAAGCTTGTTGAAAACCCAGAC
TGTCTCCACGGCCTGCCCAGTCGACGCCAAAGGAACACTGACATCAATTTTACCCTGAGGTCACTGCTAGAGACG
CTGATCCATAAAGACAATCACTGCCAACCCCTCTTTCGTCTACTGCAAGAGCCAAGTTCCAAAATAAAGCATAAA
AAGGTTTTTAAAAGGAAATGTAAAAGCACATGAGAATGCTAGCAGGCTGTGGGGCAGCTGAGCAGCTTTTCTCC
CCCCATATCTGCGTGCACTTCCCAGAGCATCTTGCATCCAAACCTGTAACCTTTCGGCAAGGACGGTAACTTGGC
TGCATTTGCCTGTCATGCGCAACTGGAGCCAGCAACCAGCTATCCATCAGCACCCCAGTGGAGGAGTTCATGGAA
GAGTTCCCTCTTTGTTTCTGCTTCATTTTTCTTTCTTTCTTTTCTCCTAAAGCTTTTATTTAACAGTGCAAAAG
GATCGTTTTTTTTGCTTTTTAAACTTGAATTTTTTAATTTACACTTTTTAGTTTTAATTTTCTTGTATATTT
TGCTAGCTATGAGCTTTTAAATAAAATTGAAAGTTCTGGAAAAGTTTGAAATAATGACATAAAAAGAAGCCTTCT
TTTTCTGAGACAGCTTGTCTGGTAAGTGGCTTCTCTGTGAATTGCCTGTAACACATAGTGGCTTCTCCGCCCTTG
TAAGGTGTTCAGTAGAGCTAAATAAATGTAATAGCCAAACCCCACTCTGTTGGTAGCAATTGGCAGCCCTATTTC
AGTTTATTTTTTCTTCTGTTTCTTCTTTTCTTTTTTAAACAGTAAACCTTAACAGATGCGTTCAGCAGACTGG
TTTGCAGTGAATTTTCATTTCTTTCCTTATCACCCCCTTGTTGTAAAAAGCCCAGCACTTGAATTGTTATTACTT
TAAATGTTCTGTATTTGTATCTGTTTTATTAGCCAATTAGTGGGATTTATGCCAGTTGTTAAAATGAGCATTG
ATGTACCCATTTTTTAAAAAAGCAAGCACAGCCTTTGCCCAAAACTGTCATCCTAACGTTTGTCATTCCAGTTTG
AGTTAATGTGCTGAGCATTTTTTAAAAGAAGCTTTGTAATAAAACATTTTTAAAAATTGTCATTTAAAAAAAAA
AAAAAAAA
```

FIGURE 447

MPQLSGGGGGGGGDPELCATDEMIPFKDEGDPQKEKIFAEISHPEEEGDLADIKSSLVNESEIIPASNGHEVARQ
AQTSQEPYHDKAREHPDDGKHPDGGLYNKGPSYSSYSGYIMMPNMNNDPYMSNGSLSPPIPRTSNKVPVVQPSHA
VHPLTPLITYSDEHFSPGSHPSHIPSDVNSKQGMSRHPPAPDIPTFYPLSPGGVGQITPPLGWQGQPVYPITGGF
RQPYPSSLSVDTSMSRFSHHMIPGPPGPHTTGIPHPAIVTPQVKQEHPHTDSDLMHVKPQHEQRKEQEPKRPHIK
KPLNAFMLYMKEMRANVVAECTLKESAAINQILGRRWHALSREEQAKYYELARKERQLHMQLYPGWSARDNYGKK
KKRKREKLQESASGTGPRMTAAYI

FIGURE 448

```
CACCAAGGGCTGGCCGCAGCCACTGTAGCTGAGCTCAGAGCCTTCTGTGTGGTTTGCGGGGGCAAGGTCAGCTGC
CCCCTGCCCTCTCTCTGGGGCTATTTGAGGAATGCGGCCTTTTTGCATAAGAAAGGCTTTTCTCTACAGTAACTG
TGGTCGCTGATCAATGACACCTTCCTGGTAACATTTCATATTGCTTTTTTGGAGATACTTTGACGAAGGTAATTG
GGACTCCCATCAAGTCTCCACACAGCTAGCAGCCACGTGGGGCACTTCTCCAGCATATGTAAGTGGAACTCAGAA
GGCAACATTCCCTGAACATACTCTTCCACCAGAATCTCCTCTACAGATTTTTGCTGCCCCTTTTACCAGTGGCTG
AATCTACTTTCTCCTATGGATCGCTTACACCTGAGACGAACTACAGAACAGCACGTACCAGAGGTGGAAGTCCAA
GTCAAACGCAGAAGGACTGCCTCACTGAGCAACCAAGAGTGTCAGTTGTACCCGAGGCGTTCTCAGCAGCAGCAA
GTACCTGTGGTGGATTTCCAGGCTGAACTGAGGCAGGCATTCTTAGCTGAGACACCAAGAGGTGGTTAAAGCCAT
ATTGGAGTAGCGAGGAATCTGATTCCAAGCAAAAACCAGGCTCCATCTACTCTTTGAAGCTTCTGCCCAGCTTGC
ATTGTTTCTAGGAGAACCCGCGTCATACCTTTATCTATAGCCTTCCCCTAGGTCTTCAGAAGCATCAAGTTTTAA
CTGTGGACATTGGATTTGGTGGAACAGCAATCATGACTGTTGGCAAGAGTAGCAAGATGCTGCAGCACATTGACT
ATAGAATGAGATGTATCCTGCAAGATGGCCGAATCTTCATTGGCACCTTTAAGGCTTTTGACAAGCATATGAATT
TGATCCTCTGTGATTGTGATGAGTTCAGAAAGATCAAGCCAAAGAATGCGAAGCAACCAGAGCGTGAAGAAAAGC
GGGTTTTGGGTCTGGTGTTGCTGCGTGGGGAGAACTTGGTATCCATGACTGTGGAGGGGCCACCCCCCAAAGATA
CTGGCATTGCTCGGGTACCACTTGCTGGAGCTGCTGGAGGCCCTGGGGTTGGTAGGGCAGCTGGTAGAGGAGTAC
CAGCTGGTGTGCCAATTCCCCAGGCCCCTGCTGGATTGGCAGGCCCTGTCCGAGGAGTTGGGGGACCATCCCAGC
AGGTAATGACTCCACAGGGAAGAGGCACTGTAGCAGCTGCTGCTGTTGCTGCGACTGCCAGTATTGCTGGAGCCC
CAACACAGTACCCACCAGGACGGGGCACTCCGCCCCCACCCGTCGGCAGAGCAACCCCACCTCCAGGCATTATGG
CTCCTCCACCTGGTATGAGACCACCCATGGGCCCACCAATTGGGCTTCCCCCTGCTCGAGGGACGCCAATAGGCA
TGCCGCCTCCGGGAATGAGACCCCCTCCACCAGGCATTAGAGGTCCACCTCCCCCAGGAATGCGTCCACCAAGAC
CTTAGCATACTGTTGATCCATCTCAGTCACTTTTTCCCCTGCAATGCGTCTTGTGAAATTGTGTAGAGTGTTTGT
GAGCTTTTGTTCCCTCATTCTGCATTAATAATAGCTAATAATAAATGCATAGAGCAATTAAACTGTG
```

FIGURE 449

MTVGKSSKMLQHIDYRMRCILQDGRIFIGTFKAFDKHMNLILCDCDEFRKIKPKNAKQPEREEKRVLGLVLLRGE
NLVSMTVEGPPPKDTGIARVPLAGAAGGPGVGRAAGRGVPAGVPIPQAPAGLAGPVRGVGGPSQQVMTPQGRGTV
AAAAVAATASIAGAPTQYPPGRGTPPPPVGRATPPPGIMAPPPGMRPPMGPPIGLPPARGTPIGMPPPGMRPPPP
GIRGPPPPGMRPPRP

FIGURE 450

```
ACATTTTCTATGTAGTAAACATGTATGTGTATGTGTGTGGGTGTGTGTCTAATTACTTTGTTGGACAGATTCCTG
TGGTTTGGAACTGCTGGGGCCAAGTTTATACAAAAATCTACATTTTTGAGTAAACTCCCCATGACTCTAGTAAGT
TTCCACAGTATTTGAGTATTCTTTATTTCCTAAAGCTGTACAAACATCAGATAATCAATATTTGTAAGGATCGAT
AATATAATTTATAATGAAATTGCTTTATCAGCTATTAATGTTAACTACATCATCTTCATATAGCCTTATAACTCA
TTTGTGCTATTCCATTTTCCTCTGTTCCTTTTATTTTCACTTCCCTTGTAATGTTAGTCTCTTTGTACTGATTTC
TGAAGAGTTCATTTATGATTAAACATGTTAACATTTTGTCTAGAATTGCAAATATGTTTTTTCTCATTCATTTTA
CTATGGTGTTTTATTTTTTGGTTATACAGAAGTTGTATATTGAAATATAATCTTGTTCTGTTTTATGACTTTGGA
GTTTTGTGGTTTTTAAAACATGTTTACATTGGTATCATTTATTTGTATTGCCTTCTATTTCAGCAGTTAGTTTG
TCATTTCTTTTTCCATTAATCATCATTCTGGTGTTAATGAATGCATTAAATATTTAAAGTAAAAAAAAAAAAAAA
AAA
```

FIGURE 451

MCMCVGVCLITLLDRFLWFGTAGAKFIQKSTFLSKLPMTLVSFHSI

FIGURE 452

```
GAAAGAGACAAAGCAGCAATTAAAGTCAGCCCAGCACCAACTCCGACGCCAAGCGTTACACTGGAAACTACTTTT
TAAAGCAACAAAAGAGTCTAAAACAAAATACAACATTTCTTAAATACACTGTTTCCAGAAAGAGCTATTTTAACA
GAAGCAACTCAAAGATATCCCTTCGACAGAAGTGGAAGTGCTGAAAAATGCTCATCTCTCACACAGACTTTTGAT
GGACAGGAGTTTCTAAGTATCATGCCTACCAACAAGCTGTAAAATGATCACCCTGAACAATCAAGATCAACCTGT
CCCTTTTAACAGCTCACATCCAGATGAATACAAAATTGCAGCCCTTGTCTTCTATAGCTGTATCTTCATAATTGG
ATTATTTGTTAACATCACTGCATTATGGGTTTTCAGTTGTACCACCAAGAAGAGAACCACGGTAACCATCTATAT
GATGAATGTGGCATTAGTGGACTTGATATTTATAATGACTTTACCCTTTCGAATGTTTTATTATGCAAAAGATGA
ATGGCCATTTGGAGAGTACTTCTGCCAGATTCTTGGAGCTCTCACAGTGTTTTACCCAAGCATTGCTTTATGGCT
TCTTGCCTTTATTAGTGCTGACAGATACATGGCCATTGTACAGCCGAAGTACGCCAAAGAACTTAAAAACACGTG
CAAAGCCGTGCTGGCGTGTGTGGGAGTCTGGATAATGACCCTGACCACGACCACCCCTCTGCTACTGCTCTATAA
AGACCCAGATAAAGACTCCACTCCCGCCACCTGCCTCAAGATTTCTGACATCATCTATCTAAAAGCTGTGAACGT
GCTGAACCTCACTCGACTGACATTTTTTTTCTTGATTCCTTTGTTCATCATGATTGGGTGCTACTTGGTCATTAT
TCATAATCTCCTTCACGGCAGGACGTCTAAGCTGAAACCCAAAGTCAAGGAGAAGTCCATAAGGATCATCATCAC
GCTGCTGGTGCAGGTGCTCGTCTGCTTTATGCCCTTCCACATCTGTTTCGCTTTCCTGATGCTGGGAACGGGGGA
GAACAGTTACAATCCCTGGGGAGCCTTTACCACCTTCCTCATGAACCTCAGCACGTGTCTGGATGTGATTCTCTA
CTACATCGTTTCAAAACAATTTCAGGCTCGAGTCATTAGTGTCATGCTATACCGTAATTACCTTCGAAGCATGCG
CAGAAAAAGTTTCCGATCTGGTAGTCTACGGTCACTAAGCAATATAAACAGTGAAATGTTATGAATAATAAGGTT
CTTTCATTTCAATCCCATCAAAATTCACTTCACTAACTACTCTGGCGTCAATGGATATTCTGTATAATACTATCA
AGTCCCTTTTCTCTTGAAAAAATAAATTCATTATCTTCATTTTAAAAAAAAAAAAAAAAA
```

FIGURE 453

```
MITLNNQDQPVPFNSSHPDEYKIAALVFYSCIFIIGLFVNITALWVFSCTTKKRITVTIYMMNVALVDLIFIMTL
PFRMFYYAKDEWPFGEYFCQILGALTVFYPSIALWLLAFISADRYMAIVQPKYAKELKNTCKAVLACVGVWIMTL
TTTTPLLLLYKDPDKDSTPATCLKISDIIYLKAVNVLNLTRLTFFFLIPLFIMIGCYLVIIHNLLHGRTSKLKPK
VKEKSIRIIITLLVQVLVCFMPFHICFAFLMLGTGENSYNPWGAFTTFLMNLSTCLDVILYYIVSKQFQARVISV
MLYRNYLRSMRRKSFRSGSLRSLSNINSEML
```

FIGURE 454

CCTTCCTTTCGTTCCTTCCAGAGAATTTGTGTTCTCTGTACCTGAGATCAAATGTGTGTCTAAGCAATTCTGGCC
CCTGGCTCCCACCACCCTACCCTCTCCACAAAATAATAGACATTAGGGGAGGTAAGGGAACAGAAGAGGTCTCTT
TGCAGATATTATATTTT<u>TAA</u>AAAATGGTTCTATGTAATAAGCAGCAGCTAAGGAGACAGAAAGACAGTAGATGAA
GAGAGTGCCAATATCTTCCATGGGGAAAAATGAATGAACTGAAAGAGAATATTATTTTTCTAGAATACAGAAAGC
TGTCCTCTCACAGATCAGCTGGAATTCCAAGGTGGATTATGGACTTCTTCTAACTCCCATTGATAGTGCTTCTTA
CCAGGTGAAGGGAAGGGCTACTTTTTCCTAAAGGAGAAAAAAGCTTTCAGACAAAGCTCGTACCAACCCCTGAAC
TGCAAATTTGCTCAAGTGACCGTGCATACTTATATTCCTAATTTAAATGATTATTTATGTCAAACGCTCATTGTG
AAACTTGAAAATGTTGTATTACATTACATCAAATAAAGTTTACTTGTAGCAGACAGAAAGAGAGAAAGAGAAAGA
AAGGAAAGANNNNNNNNNNNNNNNNNNNNNNNNNNNNNNNNNNNNNNNNNNNNGGAAATAAAGAAATTAAAGGGCTGGG
CTTACAGGAGCCTGGAGGGTTGGGAGATCTACAGGGGTTTTACCACCGGGGAACTTGAGGCTGAGGGTCCAGTCA
CTGTGGGCAGTGACAGGTGTGGATGTGGTGTCTTCTGGGAAGGGGCCTGCTGACAACAAGCTTCCTCCAGCCCTG
GCTGGACATAGAGGGAAACAAAGTCACCGATCCTCAGTCCACCAGAAGGCAGTTTTGACCTTGAAGAAGAGGGCT
A

FIGURE 455

FLSFLPENLCSLYLRSNVCLSNSGPWLPPPYPLHKIIDIRGGKGTEEVSLQILYF

FIGURE 456

```
GAGATTCCGGCCTGGAGCTCCCAGGGCCGAGGTCACTTTGGTGGCAGTTCATGGAGAATAGCTTGAGGTGACAAG
ACAGCAGACACGACGTGGGTCTCTGGGACTGCCTGTGCCGTTGTGGGCAGCCCCTCCAGAGCCCTGAGTCACGCA
GCCTTCAGAGGCACCCATGGCTACGAGAAGCACAGTCTCTGCCTGAGGCTCCAGAGCGGCCCTTTTTCCCCAGCA
GCAGACCTTGGGACCTGTGAGCGCTGCATCCAATTAACCATGGGAAGGGTCAGCACCAGCCACCAGCCCCTTAGG
TGAGGACTCTGCCTGGGGCTCTGCTGATGGTTCCGAATCATGGAGCTGCAGAGAGCTCCTCCAGCCTGGAGACGT
TCTTGGTGAAAGCTGTGGTCTAACTCCACCGGCTCTTCCTGCACATTGTATTCAAGAGGGGTGCCTGCCCCCGCT
GACTCAGGAGCTCCGGTGCTGCAGCCGCCACGAATGGGAGGTGGGCCCTCGATGTGGCCTTTTGTGGAAGGCG
GTGTTGACCCTGGGGCTGGTGCTTCTCTACTACTGCTTCTCCATCGGCATCACCTTCTACAACAAGTGGCTGACA
AAGAGCTTCCATTTCCCCCTCTTCATGACGATGCTGCACCTGGCCGTGATCTTCCTCTTCTCCGCCCTGTCCAGG
GCGCTGGTTCAGTGCTCCAGCCACAGGGCCCGTGTGGTGCTGAGCTGGGCCGACTACCTCAGAAGAGTGGCTCCC
ACAGCTCTGGCGACGGCGCTTGACGTGGGCTTGTCCAACTGGAGCTTCCTGTATGTCACCGTCTCGCTGTACACA
ATGACCAAATCCTCAGCTGTCCTCTTCATCTTGATCTTCTCTCTGATCTTCAAGCTGGAGGAGCTGCGCGCGGCA
CTGGTCCTGGTGGTCCTCCTCATCGCCGGGGGTCTCTTCATGTTCACCTACAAGTCCACACAGTTCAACGTGGAG
GGCTTCGCCTTGGTGCTGGGGGCCTCGTTCATCGGTGGCATTCGCTGGACCCTCACCCAGATGCTCCTGCAGAAG
GCTGAACTCGGCCTCCAGAATCCCATCGACACCATGTTCCACCTGCAGCCACTCATGTTCCTGGGGCTCTTCCCT
CTCTTTGCTGTATTTGAAGGTCTCCATTTGTCCACATCTGAGAAAATCTTCCGTTTCCAGGACACAGGGCTGCTC
CTGCGGGTACTTGGGAGCCTCTTCCTTGGCGGGATTCTCGCCTTTGGTTTGGGCTTCTCTGAGTTCCTCCTGGTC
TCCAGAACCTCCAGCCTCACTCTCTCCATTGCCGGCATTTTTAAGGAAGTCTGCACTTTGCTGTTGGCAGCTCAT
CTGCTGGGCGATCAGATCAGCCTCCTGAACTGGCTGGGCTTCGCCCTCTGCCTCTCGGGAATATCCCTCCACGTT
GCCCTCAAAGCCCTGCATTCCAGAGGTGATGGTGGCCCCAAGGCCTTGAAGGGGCTGGGCTCCAGCCCCGACCTG
GAGCTGCTGCTCCGGAGCAGCCAGCGGGAGGAAGGTGACAATGAGGAGGAGGAGTACTTTGTGGCCCAGGGGCAG
CAGTGACCAGCCAGGGCAAATGGCTTAGAAGCAGGCCACTCCCCAGCCTGCTGCCAGCACTCACTGTGCTCAAGC
CGCCAGGGCTCATCATGGTAGCTGGGAGCTGTGGACGGGAGTCACCAGGTGGTGGGGCCAAGCCAGGGACTCATG
ACTTTTGCCCCTCCCTTCAGAGCCTGGTCACACAAGGGGCGAGCACCAGGCCAGCCTGGGACTGGCCAGAGCTGG
GCCCAAGCTGCGCTGGAATCGCAGCAGGAGAGGGGAGTGGGCTGGTTCTTCCCACCACTTCCCAGGCTCTGACAG
CCGAGACTCATTTCCAAGGCACAGCAGCTTTCTAAAGGGACTGAGTTTGGACTGGGTTTTGGACCTCCAGGGGCT
GGAGCTTCATCACCTGGGCAGTGTCTTTTCTCAGAGAGCAGGTTTCTTTATAGTTTGGAAATAAATGGTTCACGG
TCAAAAAAAAAAAAAAAAAAAAA
```

FIGURE 457

MGRWALDVAFLWKAVLTLGLVLLYYCFSIGITFYNKWLTKSFHFPLFMTMLHLAVIFLFSALSRALVQCSSHRAR
VVLSWADYLRRVAPTALATALDVGLSNWSFLYVTVSLYTMTKSSAVLFILIFSLIFKLEELRAALVLVVLLIAGG
LFMFTYKSTQFNVEGFALVLGASFIGGIRWTLTQMLLQKAELGLQNPIDTMFHLQPLMFLGLFPLFAVFEGLHLS
TSEKIFRFQDTGLLLRVLGSLFLGGILAFGLGFSEFLLVSRTSSLTLSIAGIFKEVCTLLLAAHLLGDQISLLNW
LGFALCLSGISLHVALKALHSRGDGGPKALKGLGSSPDLELLLRSSQREEGDNEEEEYFVAQGQQ

FIGURE 458A

```
GCGGCGCTGGGTCGGTGGCGGAGGCTGAGGAGAAGGAGGAGCGGGCCGTGGAGGCTTCGCCGCCTAGGTACTGCT
ATAACCAGAATTTGGTAGAAAAAGGATTTACTTGTTGGGGCCCTCTTGATAAAAAGAGATGTGGGGGGATTCTCG
ACCTGCTAACAGAACTGGACCTTTTCGTGGGAGCCAAGAAGAAAGGTTTGCTCCCGGGTGGAACAGGGATTATCC
TCCTCCTCCCCTTAAGAGTCATGCTCAAGAGAGACACTCTGGCAACTTTCCTGGCAGAGATTCACTTCCCTTTGA
TTTCCAGGGGCATTCGGGGCCTCCTTTTGCAAATGTAGAGGAGCATTCTTTCAGCTATGGAGCTAGAGACGGACC
GCATGGTGACTATCGAGGAGGGGAGGGACCTGGACATGATTTCAGGGGGGGAGATTTTCGTCTTCTGATTTCCA
GAGCAGAGATTCATCACAGTTGGACTTCAGGGGTAGGGACATACATTCTGGGGATTTTCGGGATAGAGAAGGACC
ACCTATGGACTATAGGGGTGGAGATGGTACTTCTATGGATTATAGAGGTAGGGAGGCACCTCATATGAACTACAG
AGACAGGGATGCTCACGCTGTTGACTTCAGAGGTAGGGATGCTCCTCCATCTGACTTCAGGGGCCGGGGCACTTA
TGATTTAGATTTTAGAGGCCGGGATGGATCCCATGCAGATTTTAGGGGAAGGGATTTATCAGATTTGGATTTTAG
GGCCAGAGAACAGTCCCGTTCTGATTTTAGGAATAGAGATGTATCTGATTTGGACTTTAGAGACAAAGACGGAAC
ACAAGTAGACTTTAGAGGCCGAGGTTCAGGTACTACTGATCTAGACTTTAGGGACAGGGATACGCCACATTCAGA
TTTCAGAGGTAGACACCGATCTAGGACTGATCAGGATTTTAGGGGCAGAGAGATGGGATCTTGTATGGAATTTAA
AGATAGGGAGATGCCCCTGTGGATCCAAATATTTTGGATTACATTCAGCCCTCTACACAAGATAGAGAACATTC
TGGTATGAATGTGAACAGGAGAGAAGAATCCACACATGACCATACGATAGAAAGGCCTGCTTTTGGCATTCAGAA
GGGAGAATTTGAGCATTCAGAAACAAGAGAAGGAGAAACACAAGGTGTAGCCTTTGAACATGAGTCTCCAGCAGA
CTTTCAGAACAGCCAAAGTCCAGTTCAAGACCAAGATAAGTCACAGCTTTCTGGACGTGAAGAGCAGAGTTCAGA
TGCTGGTCTGTTTAAAGAAGAAGGCGGTCTGGACTTTCTTGGGCGGCAAGACACCGATTACAGAAGCATGGAGTA
CCGTGATGTGGATCATAGGCTGCCAGGAAGCCAGATGTTTGGCTATGGCCAGAGCAAGTCTTTTCCAGAGGGCAA
AACTGCCCGAGATGCCCAACGGGACCTTCAGGATCAAGATTATAGGACCGGCCCAAGTGAGGAGAAACCCAGCAG
GCTTATTCGATTAAGTGGGGTACCTGAAGATGCCACAAAAGAAGAGATTCTTAATGCTTTCGGACTCCTGATGG
CATGCCTGTAAAGAACTTGCAGTTGAAGGAGTATAACACAGGTTACGACTATGGCTATGTCTGCGTGGAGTTTC
ACTCTTGGAAGATGCCATCGGATGCATGGAGGCCAACCAGGGAACTCTAATGATCCAGGACAAAGAAGTTACCCT
GGAGTATGTATCAAGCCTGGATTTTTGGTACTGCAAACGATGTAAGGCAAACATTGGTGGGCACCGATCTTCCTG
TTCATTCTGCAAGAACCCAAGAGAAGTGACAGAGGCCAAGCAAGAATTAATAACCTACCCTCAGCCTCAGAAAAC
ATCCATACCAGCACCATTGGAAAAACAGCCCAACCAGCCCCTAAGACCAGCTGATAAGGAACCTGAACCCAGGAA
GAGGGAAGAAGGCCAAGAGTCACGCTTAGGACATCAAAAGAGAGAAGCAGAAAGGTATCTGCCTCCTTCTCGAAG
GGAAGGGCCAACTTTCCGAAGAGACCGAGAGAGGGAGTCATGGTCTGGAGAGACACGCCAGGATGGAGAGAGCAA
AACTATCATGCTAAAGCGTATCTATCGTTCCACACCACCTGAGGTGATAGTGGAAGTGCTGGAGCCCTATGTCCG
CCTTACTACTGCCAACGTCCGTATCATCAAGAACAGAACAGGCCCTATGGGGCATACCTATGGCTTTATTGACCT
CGACTCCCATGCGGAAGCTCTTCGTGTGGTGAAGATCTTACAGAACCTTGATCCGCCATTTAGCATTGATGGGAA
GATGGTAGCTGTAAACCTGGCCACTGGAAAACGAAGAAATGATTCTGGGGACCATTCTGACCACATGCATTACTA
TCAGGGTAAAAAATATTTCCGAGATAGGAGGGGAGGTGGCAGAAATTCAGACTGGTCTTCAGATACAAATCGACA
AGGACAACAGTCATCATCTGACTGCTACATATATGATTCTGCTACTGGCTACTATTATGACCCCTTGGCAGGAAC
TTATTATGACCCCAATACCCAGCAAGAAGTCTATGTGCCCCAGGATCCTGGATTACCTGAGGAAGAAGAGATCAA
GGAAAAAAAACCCACCAGTCAAGGAAAGTCAAGTAGCAAGAAGGAAATGTCTAAAAGAGATGGCAAGGAGAAAAA
AGACAGAGGAGTGACGAGGTTTCAGGAAAATGCCAGTGAAGGGAAGGCCCCTGCAGAAGACGTCTTTAAGAAGCC
CCTGCCTCCTACTGTGAAGAAGGAAGAGAGTCCCCCTCCACCTAAAGTGGTAAACCCACTGATCGGCCTCTTGGG
TGAATATGGAGGAGACAGTGACTATGAGGAGGAAGAAGAGGAGGAACAGACCCCTCCCCCACAGCCCCGCACAGC
ACAGCCCCAGAAGCGAGAGGAGCAAACCAAGAAGGAGAATGAAGAAGACAAACTCACTGACTGGAATAAACTGGC
TTGTCTGCTTTGCAGAAGGCAGTTTCCCAATAAAGAAGTTCTGATCAAACACCAGCAGCTGTCAGACCTGCACAA
GCAAAACCTGGAAATCCACCGGAAGATAAAACAGTCTGAGCAGGAGCTAGCCTATCTGGAAAGGAGAGAACGAGA
GGGAAAGTTTAAAGGAAGAGGAAATGATCGCAGGGAAAAGCTCCAGTCTTTTGACTCTCCAGAAAGGAAACGGAT
TAAGTACTCCAGGGAAACTGACAGTGATCGTAAACTTGTTGATAAAGAAGATATCGACACTAGCAGCAAAGGAGG
CTGTGTCCAACAGGCTACTGGCTGGAGGAAAGGGACAGGCCTGGGATATGGCCATCCTGGATTGGCTTCATCAGA
GGAGGCTGAAGGCCGGATGAGGGGCCCCAGTGTTGGAGCCTCAGGAAGAACCAGCAAAAGACAGTCCAACGAGAC
TTATCGAGATGCTGTTCGAAGAGTCATGTTTGCTCGATATAAAGAACTCGATTAAGAAAGGAGACAAGTTCCATG
GGATACAACCTCCCTCTTGTTTTGTTTGTCTCTCCTTTTCTTTTGTTACTGTTCTTGCTGCTAGAACTTTTTAA
```

FIGURE 458B

ATAAACTTTTTTTCAATGTGAAAAAAAAAAAAAAAAA

FIGURE 459

```
MWGDSRPANRTGPFRGSQEERFAPGWNRDYPPPPLKSHAQERHSGNFPGRDSLPFDFQGHSGPPFANVEEHSFSY
GARDGPHGDYRGGEGPGHDFRGGDFSSSDFQSRDSSQLDFRGRDIHSGDFRDREGPPMDYRGGDGTSMDYRGREA
PHMNYRDRDAHAVDFRGRDAPPSDFRGRGTYDLDFRGRDGSHADFRGRDLSDLDFRAREQSRSDFRNRDVSDLDF
RDKDGTQVDFRGRGSGTTDLDFRDRDTPHSDFRGRHRSRTDQDFRGREMGSCMEFKDREMPPVDPNILDYIQPST
QDREHSGMNVNRREESTHDHTIERPAFGIQKGEFEHSETREGETQGVAFEHESPADFQNSQSPVQDQDKSQLSGR
EEQSSDAGLFKEEGGLDFLGRQDTDYRSMEYRDVDHRLPGSQMFGYGQSKSFPEGKTARDAQRDLQDQDYRTGPS
EEKPSRLIRLSGVPEDATKEEILNAFRTPDGMPVKNLQLKEYNTGYDYGYVCVEFSLLEDAIGCMEANQGTLMIQ
DKEVTLEYVSSLDFWYCKRCKANIGGHRSSCSFCKNPREVTEAKQELITYPQPQKTSIPAPLEKQPNQPLRPADK
EPEPRKREEGQESRLGHQKREAERYLPPSRREGPTFRRDRERESWSGETRQDGESKTIMLKRIYRSTPPEVIVEV
LEPYVRLTTANVRIIKNRTGPMGHTYGFIDLDSHAEALRVVKILQNLDPPFSIDGKMVAVNLATGKRRNDSGDHS
DHMHYYQGKKYFRDRRGGGRNSDWSSDTNRQGQQSSSDCYIYDSATGYYYDPLAGTYYDPNTQQEVYVPQDPGLP
EEEEIKEKKPTSQGKSSSKKEMSKRDGKEKKDRGVTRFQENASEGKAPAEDVFKKPLPPTVKKEESPPPPKVVNP
LIGLLGEYGGDSDYEEEEEEEQTPPPQPRTAQPQKREEQTKKENEEDKLTDWNKLACLLCRRQFPNKEVLIKHQQ
LSDLHKQNLEIHRKIKQSEQELAYLERREREGKFKGRGNDRREKLQSFDSPERKRIKYSRETDSDRKLVDKEDID
TSSKGGCVQQATGWRKGTGLGYGHPGLASSEEAEGRMRGPSVGASGRTSKRQSNETYRDAVRRVMFARYKELD
```

FIGURE 460

```
TTATGCCGGGGAGGGCTGAGCTATCGCTAGGGAACCCACGGTGACTGAATCAAAGGGAAGAAAGACCCAAGACCT
GGATCTCCCTTTTACATGGACCCTAAAGCAAAGGAAAATGGCAAATGCACGACAGCGGCCTCCTGAACATCACCA
AGGTATCCTTCTCAGACCGAGGTAAATACACGTGTGTGGCTTCTAACATCTACGGCACCGTGAACAACACGGTGA
CCTTGCGCGTCATCTTCACTTCTGGAGACATGGGTGTCTACTACATGGTCGTGTGCCTGGTGGCCTTCACCATCG
TCATGGTCCTCAATATCACCCGCCTGTGCATGATGAGCAGCCATCTAAAGAAGACTGAGAAGGCCATCAATGAGT
TCTTTAGGACCGAAGGTGCAGAGAAGCTGCAGAAGGCATTTGAGATCGCCAAGCGCATCCCCATCATCACCTCCG
CCAAAACTCTAGAGCTTGCCAAAGTCACCCAGTTCAAAACCATGGAGTTCGCCCGCTACATCGAAGAGCTTGCCA
GGAGCGTGCCTCTGCCGCCTCTCATTATGAACTGCAGGACTATCATGGAGGAGATTATGGAGGTGGTTGGGCTGG
AGGAGCAGGGGCAGAATTTTGTGAGGCATACTCCAGAGGGCCAGGAGGCCGCAGACAGGGATGAGGTCTACACAA
TCCCCAACTCTCTGAAGCGGAGCGACTCCCCTGCCGCTGACTCGGACGCCTCATCGCTGCACGAGCAACCTCAGC
AAATTGCCATCAAGGTGTCAGTTCACCCGCAGTCCAAAAAAGAGCATGCAGATGACCAAGAGGGTGGACAGTTTG
AAGTCAAAGATGTAGAGGAGACAGAACTGTCGGCGGAACATTCCCCCGAAACTGCAGAACCTTCTACCGATGTCA
CGTCCACCGAGCTAACATCTGAAGAGCCAACACCTGTTGAGGTACCAGATAAGGTACTGCCGCCAGCTTACCTGG
AAGCCACAGAGCCAGCAGTGACACATGACAAAAACACCTGCATTATTTACGAAAGCCATGTCTAATACCAACCCC
GAAAAGCTATGCATATCAAGAAAATCAGGGGCTGCTCCTTGTAATACAGATGTAGTACGCACTTGCCGCTAAGCC
TTACCAGGAGACTCTCATCCCTTAGGTAGGAGTGATGCCACTTTAAAAGGAGAAACACCTGCCTGCAGTGAATGG
GACTGGAATTTCCCCAGTAGAGAAGGGTGCGAGAAACATCAGGGTGCAGAATTGATACCAGACAGAAGGTGTCTA
TGTGATAATGAGTTTCAGAGGCTGATCTCTGCCAAATACCTTAATTGGTGATGCCTTCTTGGCAAAGAGTACACC
ACTGTAAGATATTCTGAGTTCAAGAACCCTGTCCAGTGCCCCCTGCATTGCTTTTCCTTTTAAAAAGTATAGGTC
TGCTACAATAGCAAACGCACGTACGTGGGTTTTTGCAGTTTCTTCTCAGTTTTAATTTTGCTTTTCCTTTATAA
TGGGGTCATTGTTATTAATACTAATTGTTCTTTCTGGTTTAGTCCTCATTGCCACTTTTGTCCTTATGTTTCCCT
AGAACACGTACCTCAGAGACTTTGGTATCAGTCACCAGTACCAGGGCTGATATCTACAAGTCACATTACATTTGT
CATGTTCCAAAGTAGTTACGAGGCTTGTTATTTTTTTTCATTCCCCAGGCCTATTCCATAGATAGCTTTTTTT
GTTTGTTTCCAACGAAGCTGCTGTTAAACGAAACTGAGAAAAACTTTGCCCCGGAATAGCACTTTAATAGTCAAA
AATGTGTTTACCTGTCTGATTGAGTGAGCCTTTTGGTGAGCTCAGCTGAGATGTAGAGGGAGATTGTAAAAGGTT
AAATATACCCACACCACCCATGAAAGTCACTGTTTAAGTTACATCATCCTCCAAATAAAGACTGATTCTTTACCT
GGAAAAAAAAA
```

FIGURE 461

MHDSGLLNITKVSFSDRGKYTCVASNIYGTVNNTVTLRVIFTSGDMGVYYMVVCLVAFTIVMVLNITRLCMMSSH
LKKTEKAINEFFRTEGAEKLQKAFEIAKRIPIITSAKTLELAKVTQFKTMEFARYIEELARSVPLPPLIMNCRTI
MEEIMEVVGLEEQGQNFVRHTPEGQEAADRDEVYTIPNSLKRSDSPAADSDASSLHEQPQQIAIKVSVHPQSKKE
HADDQEGGQFEVKDVEETELSAEHSPETAEPSTDVTSTELTSEEPTPVEVPDKVLPPAYLEATEPAVTHDKNTCI
IYESHV

FIGURE 462

AAAAAAAAAAGTTCCCACAGCTCACCACTACAGAAGCAGGGAAGACAACTATGCAGAAAACAGAGTTAGTGGCGG
TCAGCAGGAATGCAGCTGGTCTTTTGGACCCCTACGGGATGGGGGCAGTGCAGAAGACACTGGTGAAGTCCTTTA
TACTGAAGACCTGTGGTTGGGAGCAGGGGTAGTCCATGGGTCTGCTGATTTTTTTCCCTATTTAGTACTAATGT
GTGTGTGATCTTTGTTTTACAAACAGTACCTTTTGGGTTTTCTGCATATTTTATAATTTTTGTACAGTTTTGAAT
TCTATAGATTGTCTTGGAAGGATACTGTGTGATGGGTCAGGCACACAGTAATTGGAGACTTTTAATGTATGTAAT
ATTTCATAGATTGCATGCTATTAATCATCTGTGAGGGTAGTATTTTTGTTTATTGTAAGTTTCCCTCTTTTTT
TATAAATTAAAAGATGGTTGGTATTAGGAATTTCAAATGAATGCAGAAAATCTTACATGCTGTGTACTATTAATA
TTATAACAGACGATCCAAGTCCAAAATCTGACCAATAAAGCAACCATTTTATCAAGATAGAGGGATTCTAATGGG
AGAGGGGATTCTTCCCTCCTGAAGTTTGTGTGTCCAGTCCCCTTAAAAAAAATGAATAGTTGTCTTTTCTTGTCA
TATTAATACTCGAAAGTCCATGGTGGTATTAATGAAAGTACACTTTATTGTTGCCTTTGAACTTACGGCCAAGGC
AATAAATCAGAAACAAAAATAGTGCCAATGTGTCAAAATCGACATCTGAGAGATTCAGCCTCCCATTTGGAATAA
ATATGAATCTTCTAAGCTATCTTGTTTAATATTTTCCATCATTTAGCTACTTCCTATCTCCCTCAGAGGCGCCTG
CTGTTCCCATTTTAGAGTTGACAGTGGCCTGCTAATTTGCTATGTTCCTAAAAGTTACTGGGTGTGAGACATTT
TCATCCCCTCCTTTTTCCTACTGCTGGTGTTTATTATCCAGCTAGACAATATTTTATGCATATTTACCGTGATGT
CTGGACCGTACCTGTGCTCCTTGGCAGTTTATGTTGAAGATAACTAAAGATTTTTCTCTTTGGGAGGCATCAAAA
TGATGGTAGTTTGCTTTTATCTTTTATGTTCATTTCTTTTAGTAGGTGACCTTTCTGCATTAAGAACTGTTTT
TATCTTTTACTACCTTTTCTTTTCTCCTTTGTGGAGACAGCATGACATGTCCTGAAGGTCACCTTTGCCTTTGAA
AAAGGTTTGATGGAGGAATTCACAGGTGACTGACAAGTCTTTGAAAAGAATGGGATCTGCTCACTTCTGGTCTTT
TTGGCCGGGAACTCCTGATTGGTGTTAAGGTGGTAATTTCCCCCATATAAGATTTAGAATCACTGAGTTTGAGCT
AGATGAAATTTTTAAAATTTCTGGTTGTCTCATTAGACTGATGAGGTGAGTTTCTTCTTCATATGAACAGCTAG
TTAATAACAGCAGAGTTCTCACTCAGTGCTCAGTACTTAATTTTCCACTGCACCACAACTGTCTTAACTAAATGT
GCTGTATTTTCTTTAAAAGTTAAGAGTTCTATTTGGTGTTTCAGGAATATACGTGAAAAGACATGCCATGTTT
TGGTAAATACCATCAGAGTTGTGTAAAGGCGTGTACTAAGTGCAATCTTAATTTGTGGAAATAATCTTCATTTAC
CCCTCCTAAAACTACACTCAGTATAAACACTTTCCCATAAGGTGTGTGCAGTAAAAATGTTATATTACTCCAACA
CTGGCAGGAGCACAGCACAGCAGCCTTATTGGAGAGAGCCTTATAAAAGTGATTAAATGGAGGCATTGAGCTCAT
TACCTTTAAGTTTACTTTGTGCTGACCTTTGTTCCTGTTTGAGAATCTCATATAATTATTAAAAAAAAAAAACA
ATTAAAACGAAACGGCGGGGCCTAGCTGTGTATAAATGATCCTTGCTGAATATCTTAAGGTTTTTGTAAGAAAA
AAGAAAAACCAACAAAAAAAGCTTATTTCACATTAAAATGAAACCTCTTTTGCAACTTAAGAATTCTATGGAAA
AGCAGTTTTTATCATATTTTGTGTCCATGCACCATTTTCTTAAAATGGCTTACAAAAAAGAATGTAAACAATTT
GTGATCTGGCCAGTTGTACTTTTAGCTCCCAGAGGGAGAGTTGGTGGTATTATGAGTTGAGTAAAAACCATCCAG
GGGAACTTGAGGGAGCAGTCTGTTGCCAGTAATGTTCCTTGTGTGCCATTAAACCACCTCCAGATGAGTGGAGGA
ACATCACTTTTTAATTTTTAATTGTATTTGGAATTGTTGCCGTGTACTAAGAACTTGACCTAAATAAAATCCCA
CAAAGTATATTCAGGTGTCTTGTTAACTTATTTATATAAATAACCTCTTTTCTAAGGTGGTATCTTGAGTTTAC
GTGTTAGGGATAATCTGACTTTCTGTTGCTCTAAACCAGGGAGCTGCCTTTTATTACTGAAGAAGTCGTCTTTT
TAAATTTTCAAAGATTTAAAATGTTGAGCTTTAAATTTGATCTCAAGTTTCTTCCCTGAAGACAGCTGTTCTAAT
TAAGAACTTTCTAATCCTGTTTTTGCTCCACTCGCACCTGGGGTTTTCTTACCACTTTTCTCCAAATCTAATTCT
GTTAATGTACAGTTTTTTTAATTCAACAGACAAACACTGAAGATGGGTGTTGACTAAAAAATATTGCAGACTGGT
CAGAAGTGAATCTAAAAGACAAACTCGCTACCTTAGGACCG

FIGURE 463

KKKVPTAHHYRSREDNYAENRVSGGQQECSWSFGPLRDGGSAEDTGEVLYTEDLWLGAGVVHGSADFFSLFSTNV
CVIFVLQTVPFGFSAYFIIFVQF

FIGURE 464A

```
TTCGCCGTTTGAATTGCTGCGGGCCCGGGCCCTCACCTCACCTGAGGTCCGGCCGCCCAGGGGTGCGCTATGCCG
TCGGGAGGTGACCAGTCGCCACCGCCCCGCCTCCCCCTCCGGCGGCGGCAGCCTCGGATGAGGAGGAGGAGGAC
GACGGCGAGGCGGAAGACGCCGCGCCGTCTGCCGAGTCGCCCACCCCTCAGATCCAGCAGCGGTTCGACGAGCTG
TGCAGCCGCCTCAACATGGACGAGGCGGCGCGGCCCGAGGCCTGGGACAGCTACCGCAGCATGAGCGAAAGCTAC
ACGCTGGAGGGAAATGATCTTCATTGGTTAGCATGTGCCTTATATGTGGCTTGCAGAAAATCTGTTCCAACTGTA
AGCAAAGGGACAGTGGAAGGAAACTATGTATCTTTAACTAGAATCCTGAAATGTTCAGAGCAGAGCTTAATCGAA
TTTTTAATAAGATGAAGAAGTGGGAAGACATGGCAAATCTACCCCCACATTTCAGAGAACGTACTGAGAGATTA
GAAAGAAACTTCACTGTTTCTGCTGTAATTTTAAGAAATATGAACCCATTTTTCAGGACATCTTTAAATACCCT
CAAGAGGAGCAACCTCGTCAGCAGCGAGGAAGGAAACAGCGGCGACAGCCCTGTACTGTGTCTGAAATTTTCCAT
TTTTGTTGGGTGCTTTTATATATGCAAAAGGTAATTTCCCCATGATTAGTGATGATTGGTCAATTCTTATCAC
CTGCTGCTGTGTGCTTTGGACTTAGTTTATGGAAATGCACTTCAGTGTTCTAATCGTAAAGAACTTGTGAACCCT
AATTTTAAAGGCTTATCTGAAGATTTTCATGCTAAAGATTCTAAACCTTCCTCTGACCCCCCTTGTATCATTGAG
AAACTGTGTTCCTTACATGATGGCCTAGTTTTGGAAGCAAAGGGGATAAAGGAACATTTCTGGAAACCCTATATT
AGGAAACTTTATGAAAAAAGCTCCTTAAGGGAAAAGAAGAAAATCTCACTGGGTTTCTAGAACCTGGGAACTTT
GGAGAGAGTTTTAAAGCCATCAATAAGGCCTATGAGGAGTATGTTTTATCTGTTGGGAATTTAGATGAGCGGATA
TTTCTTGGAGAGGATGCTGAGGAGGAAATTGGGACTCTCTCAAGGTGTCTGAACGCTGGTTCAGGAACAGAGACT
GCTGAAAGGGTGCAGATGAAAAACATCTTACAGCAGCATTTTGACAAGTCCAAAGCACTTAGAATCTCCACACCA
CTAACTGGTGTTAGGTACATTAAGGAGAATAGCCCTTGTGTGACTCCAGTTCTACAGCTACGCATAGCTTGAGT
CGTCTTCACACCATGCTGACAGGCCTCAGGAATGCACCAAGTGAGAAACTGGAACAGATTCTCAGGACATGTTCC
AGAGATCCAACCCAGGCTATTGCTAACAGACTGAAAGAAATGTTTGAAATATATTCTCAGCATTCCAGCCAGAC
GAGGATTTCAGTAATTGTGCTAAAGAAATTGCCAGCAAACATTTTCGTTTTGCGGAGATGCTTTACTATAAAGTA
TTAGAATCTGTTATTGAGCAGGAACAAAAAAGACTAGGAGACATGGATTTATCTGGTATTCTGGAACAAGATGCA
TTCCACAGATCTCTCTTGGCCTGCTGCCTTGAGGTCGTCACTTTTTCTTATAAGCCTCCTGGGAATTTTCCATTT
ATTACTGAAATATTTGATGTGCCTCTTTATCATTTTTATAAGGTGATAGAAGTATTCATTAGAGCAGAAGATGGC
CTTTGTAGAGAGGTGGTAAAACACCTTAATCAGATTGAAGAACAGATCTTAGATCATTTGGCATGGAAACCAGAG
TCTCCACTCTGGGAAAAAATTAGAGACAATGAAAACAGAGTTCCTACATGTGAAGAGGTCATGCCACCTCAGAAC
CTGGAAAGGGCAGATGAAATTTGCATTGCTGGCTCCCCTTTGACTCCCAGAAGGGTGACTGAAGTTCGTGCTGAT
ACTGGAGGACTTGGAAGGAGCATAACATCTCCAACCACATTATACGATAGGTACAGCTCCCCACCAGCCAGCACT
ACCAGAAGGCGGCTATTTGTTGAGAATGATAGCCCCTCTGATGGAGGGACGCCTGGGCGCATGCCCCCACAGCCC
CTAGTCAATGCTGTCCCTGTGCAGAATGTATCTGGGGAGACTGTTTCTGTCACACCAGTTCCTGGACAGACTTTG
GTCACCATGGCAACCGCCACTGTCACAGCCAACAATGGGCAAACGGTAACCATTCCTGTGCAAGGTATTGCCAAT
GAAAATGGAGGGATAACATTCTTCCCTGTCCAAGTCAATGTTGGGGGGCAGGCACAAGCTGTGACAGGCTCCATC
CAGCCCCTCAGTGCTCAGGCCCTGGCTGGAAGTCTGAGCTCTCAACAGGTGACAGGAACAACTTTGCAAGTCCCT
GGTCAAGTGGCCATTCAACAGATTTCCCCAGGTGGCCAACAGCAGAAGCAAGGCCAGTCTGTAACCAGCAGTAGT
AATAGACCCAGGAAGACCAGCTCTTTATCGCTTTTCTTTAGAAAGGTATACCATTTAGCAGCTGTCCGCCTTCGG
GATCTCTGTGCCAAACTAGATATTTCAGATGAATTGAGGAAAAAATCTGGACCTGCTTTGAATTCTCCATAATT
CAGTGTCCTGAACTTATGATGGACAGACATCTGGACCAGTTATTAATGTGTGCCATTTATGTGATGGCAAAGGTC
ACAAAAGAAGATAAGTCCTTCCAGAACATTATGCGTTGTTATAGGACTCAGCCGCAGGCCCGGAGCCAGGTGTAT
AGAAGTGTTTTGATAAAAGGGAAAAGAAAAAGAAGAAATTCTGGCAGCAGTGATAGCAGAAGCCATCAGAATTCT
CCAACAGAACTAAACAAGATAGAACCAGTAGAGACTCCAGTCCAGTTATGAGGTCAAGCAGCACCTTGCCAGTT
CCACAGCCCAGCAGTGCTCCTCCCACACCTACTCGCCTCACAGGTGCCAACAGTGACATGGAAGAAGAGGAGAGG
GGAGACCTCATTCAGTTCTACAACAACATCTACATCAAACAGATTAAGACATTTGCCATGAAGTACTCACAGGCA
AATATGGATGCTCCTCCACTCTCTCCCTATCCATTTGTAAGAACAGGCTCCCCTCGCCGAATACAGTTGTCTCAA
AATCATCCTGTCTACATTTCCCCACATAAAAATGAAACAATGCTTTCTCCTCGAGAAAAGATTTCTATTACTTC
AGCAACAGTCCTTCAAAGAGACTGAGAGAAATTAATAGTATGATACGCACAGGAGAAACTCCTACTAAAAGAGA
GGAATTCTTTTGGAAGATGGAAGTGAATCACCTGCAAAAGAATTTGCCCAGAAAATCATTCTGCCTTATTACGC
CGTCTCCAAGATGTAGCTAATGACCGTGGTTCCACTGAGGTTAGTCTCTTGTATTAAACTCTTCACAAAATCTG
TTTAGCAGCAGCCTTTAATGCATCTAGATTATGGAGCTTTTTTCCTTAATCCAGCTGATGAGTTACAGCCTGTTA
```

FIGURE 464B

```
GTAACATGAGGGGACATTTTGGTGAGAAATGGGACTTAACTCCTTCCAGTGTCCTTAGAACATTTTAATTCATCC
CAACTGTCTTTTTTTCCCTACCACTCAGTGATTACTGTCAAGGCTGCTTACAATCCAAACTTGGGTTTTTGGCTC
TGGCAAAGCTTTTAGAAATACTGCAAGAAATGATGTGTACCCAACGTGAGCATAGGAGGCTTCTGTTGACGTCTC
CAACAGAAGAACTGTGTTTCAAGTTCAATCCTACCTGTTTTGTGGTCAGCTGTAGTCCTCATAAAAAGCAAAACA
AAAATTAGGTATTTTGTCCTAAAACACCTGGTAGGAGTGTGTGATTTTTTGCATTCCTGACAAAGGAGAGCACAC
CCAGGTTTGGAGGTCCTAGGTCATTAGCCCTCGTCTCCCGTTCCCTTTGTGCACATCTTCCCTCTCCCCATTCGG
TGTGGTGCAGTGTGAAAAGTCCTTGATTGTTCGGGTGTGCAATGTCTGAGTGAACCTGTATAAGTGGAGGCACTT
TAGGGCTGTAAAATGCATGATTTTGTAACCCAGATTTGCTGTATATTTGTGATAGCACTTTCTACAATGTGAAC
TTTATTAAATACAAAACTTCCAGGCTAAACATCCAATATTTTCTTTAATGCTTTTATATTTTTTAAAATGTTAA
AACCCCTATAGCCACCTTTTGGGAATGTTTTAAATTCTCCAGTTTTTTGTTATATAGGGATCAACCAGCTAAGAA
AAGATTTTAAGTCAAGTTGAATTGAGGGGATTAATATGAAAACTTATGACCTCTTCCTTTAGGAGGGAGTTATCT
AAAAGAAATGTCTATTAAGGTGATATATTTAAAAATATTTTTGGGTGTTCCTGGCAGTTTAAAAAAATTGGTTGG
AGAATTTAGGTTTTTATTAGTACCATAGTACCATTTATACAAATTAGAAAATGTTATTTAACAGCTGAATTATCT
ATACATATCTTTATTAATCACTATTGTTCCAGCAGTTTTCAAGTCAAATTAATAATCTTATTAGGGAGAAAATTC
AATTGTAAATTGAATCAGTATAAACAAAGTTACTAGGTAACTTCATATTGCTGAGAGAAATATGGAACTTACATT
GTTCAATTAGAATAGTGTTCTCCCCAAATATTTATAAAACTTCTCAAGATACTGCTACGTGTAATTTATATGAA
GATAAGTGTATTTTTCAATAAAGCATTTATAAATTAAAAAAAAAAAAAAAAAA
```

FIGURE 465

```
MPSGGDQSPPPPPPPPAAAASDEEEEDDGEAEDAAPSAESPTPQIQQRFDELCSRLNMDEAARPEAWDSYRSMSE
SYTLEGNDLHWLACALYVACRKSVPTVSKGTVEGNYVSLTRILKCSEQSLIEFFNKMKKWEDMANLPPHFRERTE
RLERNFTVSAVIFKKYEPIFQDIFKYPQEEQPRQQRGRKQRRQPCTVSEIFHFCWVLFIYAKGNFPMISDDLVNS
YHLLLCALDLVYGNALQCSNRKELVNPNFKGLSEDFHAKDSKPSSDPPCIIEKLCSLHDGLVLEAKGIKEHFWKP
YIRKLYEKKLLKGKEENLTGFLEPGNFGESFKAINKAYEEYVLSVGNLDERIFLGEDAEEEIGTLSRCLNAGSGT
ETAERVQMKNILQQHFDKSKALRISTPLTGVRYIKENSPCVTPVSTATHSLSRLHTMLTGLRNAPSEKLEQILRT
CSRDPTQAIANRLKEMFEIYSQHFQPDEDFSNCAKEIASKHFRFAEMLYYKVLESVIEQEQKRLGDMDLSGILEQ
DAFHRSLLACCLEVVTFSYKPPGNFPFITEIFDVPLYHFYKVIEVFIRAEDGLCREVVKHLNQIEEQILDHLAWK
PESPLWEKIRDNENRVPTCEEVMPPQNLERADEICIAGSPLTPRRVTEVRADTGGLGRSITSPTTLYDRYSSPPA
STTRRRLFVENDSPSDGGTPGRMPPQPLVNAVPVQNVSGETVSVTPVPGQTLVTMATATVTANNGQTVTIPVQGI
ANENGGITFFPVQVNVGGQAQAVTGSIQPLSAQALAGSLSSQQVTGTTLQVPGQVAIQQISPGGQQQKQGQSVTS
SSNRPRKTSSLSLFFRKVYHLAAVRLRDLCAKLDISDELRKKIWTCFEFSIIQCPELMMDRHLDQLLMCAIYVMA
KVTKEDKSFQNIMRCYRTQPQARSQVYRSVLIKGKRKRRNSGSSDSRSHQNSPTELNKDRTSRDSSPVMRSSSTL
PVPQPSSAPPTPTRLTGANSDMEEEERGDLIQFYNNIYIKQIKTFAMKYSQANMDAPPLSPYPFVRTGSPRRIQL
SQNHPVYISPHKNETMLSPREKIFYYFSNSPSKRLREINSMIRTGETPTKKRGILLEDGSESPAKRICPENHSAL
LRRLQDVANDRGSH
```

FIGURE 466A

```
GTACGCGGACAAGATGGCGGCGGCAGCAGTCGACAGCGCGATGGAGGTGGTGCCGGCGCTGGCGGAGGAGGCCGC
GCCGGAGGTAGCGGGCCTCAGCTGCCTCGTCAACCTGCCGGGTGAGGTGCTGGAGTACATCCTGTGCTGCGGCTC
GCTGACGGCCGCCGACATCGGCCGTGTCTCCAGCACCTGCCGGCGGCTGCGCGAGCTGTGCCAGAGCAGCGGGAA
GGTGTGGAAGGAGCAGTTCCGGGTGAGGTGGCCTTCCCTTATGAAACACTACAGCCCCACCGACTACGTCAATTG
GTTGGAAGAGTATAAAGTTCGGCAAAAAGCTGGGTTAGAAGCGCGGAAGATTGTAGCCTCGTTCTCAAAGAGGTT
CTTTTCAGAGCACGTTCCTTGTAATGGCTTCAGTGACATTGAGAACCTTGAAGGACCAGAGATTTTTTTTGAGGA
TGAACTGGTGTGTATCCTAAATATGGAAGGAAGAAAAGCTTTGACCTGGAAATACTACGCAAAAAAAATTCTTTA
CTACCTGCGGCAACAGAAGATCTTAAATAATCTTAAGGCCTTTCTTCAGCAGCCAGATGACTATGAGTCGTATCT
TGAAGGTGCTGTATATATTGACCAGTACTGCAATCCTCTCTCCGACATCAGCCTCAAAGACATCCAGGCCCAAAT
TGACAGCATCGTGGAGCTTGTTTGCAAAACCCTTCGGGGCATAAACAGTCGCCACCCCAGCTTGGCCTTCAAGGC
AGGTGAATCATCCATGATAATGGAAATAGAACTCCAGAGCCAGGTGCTGGATGCCATGAACTATGTCCTTTACGA
CCAACTGAAGTTCAAGGGGAATCGAATGGATTACTATAATGCCCTCAACTTATATATGCATCAGGTTTTGATTCG
CAGAACAGGAATCCCAATCAGCATGTCTCTGCTCTATTTGACAATTGCTCGGCAGTTGGGAGTCCCACTGGAGCC
TGTCAACTTCCCAAGTCACTTCTTATTAAGGTGGTGCCAAGGCGCAGAAGGGGCGACCCTGGACATCTTTGACTA
CATCTACATAGATGCTTTTGGGAAAGGCAAGCAGCTGACAGTGAAAGAATGCGAGTACTTGATCGGCCAGCACGT
GACTGCAGCACTGTATGGGGTGGTCAATGTCAAGAAGGTGTTACAGAGAATGGTGGGAAACCTGTTAAGCCTGGG
GAAGCGGGAAGGCATCGACCAGTCATACCAGCTCCTGAGAGACTCGCTGGATCTCTATCTGGCAATGTACCCGGA
CCAGGTGCAGCTTCTCCTCCTCCAAGCCAGGCTTTACTTCCACCTGGGAATCTGGCCAGAGAAGTCTTTCTGTCT
TGTTTTGAAGGTGCTTGACATCCTCCAGCACATCCAAACCCTAGACCCGGGGCAGCACGGGGCGGTGGGCTACCT
GGTGCAGCACACTCTAGAGCACATTGAGCGCAAAAAGGAGGAGGTGGGCGTAGAGGTGAAGCTGCGCTCCGATGA
GAAGCACAGAGATGTCTGCTACTCCATCGGGCTCATTATGAAGCATAAGAGGTATGGCTATAACTGTGTGATCTA
CGGCTGGGACCCCACCTGCATGATGGGACACGAGTGGATCCGGAACATGAACGTCCACAGCCTGCCGCACGGCCA
CCACCAGCCTTTCTATAACGTGCTGGTGGAGGACGGCTCCTGTCGATACGCAGCCCAAGAAAACTTGGAATATAA
CGTGGAGCCTCAAGAAATCTCACACCCTGACGTGGGACGCTATTTCTCAGAGTTTACTGGCACTCACTACATCCC
AAACGCAGAGCTGGAGATCCGGTATCCAGAAGATCTGGAGTTTGTCTATGAAACGGTGCAGAATATTTACAGTGC
AAAGAAAGAGAACATAGATGAGTAAAGTCTAGAGAGGACATTGCACCTTTGCTGCTGCTGCTATCTTCCAAGAGA
ACGGGACTCCGGAAGAAGACGTCTCCACGGAGCCCTCGGGACCTGCTGCACCAGGAAAGCCACTCCACCAGTAGT
GCTGGTTGCCTCCTACTAAGTTTAAATACCGTGTGCTCTTCCCCAGCTGCAAAGACAATGTTGCTCTCCGCCTAC
ACTAGTGAATTAATCTGAAAGGCACTGTGTCAGTGGCATGGCTTGTATGCTTGTCCTGTGGTGACAGTTTGTGAC
ATTCTGTCTTCATGAGGTCTCACAGTCGACGCTCCTGTAATCATTCTTTGTATTCACTCCATTCCCCTGTCTGTC
TGCATTTGTCTCAGAACATTTCCTTGGCTGGACAGATGGGGTTATGCATTTGCAATAATTTCCTTCTGATTTCTC
TGTGGAACGTGTTCGGTCCCGAGTGAGGACTGTGTGTCTTTTTACCCTGAAGTTAGTTGCATATTCAGAGGTAAA
GTTGTGTGCTATCTTGGCAGCATCTTAGAGATGGAGACATTAACAAGCTAATGGTAATTAGAATCATTTGAATTT
ATTTTTTTCTAATATGTGAAACACAGATTTCAAGTGTTTTATCTTTTTTTTTAAATTTAAATGGGAATATAACA
CAGTTTTCCCTTCCATATTCCTCTCTTGAGTTTATGCACATCTCTATAAATCATTAGTTTTCTATTTTATTACAT
AAAATTCTTTTAGAAAATGCAAATAGTGAACTTTGTGAATGGATTTTTCCATACTCATCTACAATTCCTCCATTT
TAAATGACTACTTTTATTTTTAATTTAAAAAATCTACTTCAGTATCATGAGTAGGTCTTACATCAGTGATGGGT
TCTTTTTGTAGTGAGACATACAAATCTGATGTTAATGTTTGCTCTTAGAAGTCATACTCCATGGTCTTCAAAGAC
CAAAAAATGAGGTTTTGCTTTTGTAATCAGGAAAAAAAAAAATTAATGAACCTTAAAAAAAAAAAAAAAGGTTTT
GAAGGGAAAAAAAGTGGTTTCACACCTCTTGTTATTCCTTAGAGTCACTTCAAGGCCTGTTTGAATGTGGCAGGT
TAGAAAGAGAGAGAATGTCTTTCATTTGAAGAGTGTTGGACTTGTGTGAAAGGAGATGTGCGTGTTGGAATCTGC
TTTTCCAAGCCGCCAGGGTCCTGACGGCAGCAGGACGAAGCCTGTTGTGGCGTCTTCTGGGAAAGCCTGACCGTG
TGTTCGGACGGCACTGGCTCCTTTCCGAAGTTCTCAGTAACTGAGCCCAGAGTAACTGCACGCCTTTGTGCAGCT
CTGGAGCTCCACCAACTCTCGGCCTGCCAGTTCTCAAGCGAGCTAATCTTGTCATTAATCGATAGAAGCTAACTT
CCGAAGTTAGGACCTAGTTACTTTGCTCTCAACATTTAAAATAATGCAGTTGCTCTAGTGAATGGGGCGTTAGGG
GCCTGTCTCTGCACCTGTCTGTCCATCTGCATGCAGTATTCTCACCCATGTTGAATGCCTGCTGCTTGTTTACCC
TTTGGAAACCCTGGGGTGACCAAGGTTTGGAAAGCCACCTGAGACCACTTCATAGCAAGGGAAGGCTTTAAGCAG
TTACTAGAAAGAGATGGGGATTTGGCCCCTGGCTCCTCCAGCCTGAATGAGCTATTTAATCCACTGTCCATGTTC
```

FIGURE 466B

```
CTCATCAGTCAAATCCAAAGTCAAAGGATTTGAACCTGCATCTGGAAACGTAACCACTCACAGCACCTGGCCCGC
CAAGGTTGGGAGGATTGTACACTACTTTCATTTAAAGGGGAAAGTTTGATAATACGGAATTAATTAATATGAATG
AGATGCATTAATAAGAACCTGAGCATGCTGAGAGTTGCAATTGTTGGTTTTCTGGTTTGATTGATTTCCTTTTTT
CTTAGACACATCAAAGTCAAGAAAGATGGTTTTACCTTTACTGACCCAGCTGTACATATGTATCTAGACTGTTTT
TAAATGTCTTTCTTCATGAATGCTTCATGGGGCTCCAGGAAGCCTGTATCACCTGTGTAAGTTGGTATTTGGGCA
CTTTATATTTTTCTAAAAACGTGTTTTGGATCCTGTACTCTAATAAATCATAAGTTTCTTTTTAAAAATTTTCCA
AAACTTTTCTCCATTTTAAAAAGCCCTGTTATAAACGTTGAACTTTCACAATGTTAAAATGTTAAATATTTGGAT
ATAGCAACTTCTTTTCTCTTCAAATGAATGCCAAGATTTTTTTGTACAATGATTAATAAATGGAACTTATCCAGA
G
```

FIGURE 467

MAAAAVDSAMEVVPALAEEAAPEVAGLSCLVNLPGEVLEYILCCGSLTAADIGRVSSTCRRLRELCQSSGKVWKE
QFRVRWPSLMKHYSPTDYVNWLEEYKVRQKAGLEARKIVASFSKRFFSEHVPCNGFSDIENLEGPEIFFEDELVC
ILNMEGRKALTWKYYAKKILYYLRQQKILNNLKAFLQQPDDYESYLEGAVYIDQYCNPLSDISLKDIQAQIDSIV
ELVCKTLRGINSRHPSLAFKAGESSMIMEIELQSQVLDAMNYVLYDQLKFKGNRMDYYNALNLYMHQVLIRRTGI
PISMSLLYLTIARQLGVPLEPVNFPSHFLLRWCQGAEGATLDIFDYIYIDAFGKGKQLTVKECEYLIGQHVTAAL
YGVVNVKKVLQRMVGNLLSLGKREGIDQSYQLLRDSLDLYLAMYPDQVQLLLLQARLYFHLGIWPEKSFCLVLKV
LDILQHIQTLDPGQHGAVGYLVQHTLEHIERKKEEVGVEVKLRSDEKHRDVCYSIGLIMKHKRYGYNCVIYGWDP
TCMMGHEWIRNMNVHSLPHGHHQPFYNVLVEDGSCRYAAQENLEYNVEPQEISHPDVGRYFSEFTGTHYIPNAEL
EIRYPEDLEFVYETVQNIYSAKKENIDE

FIGURE 468

```
GACCCACGCGTCCGGGGAGGAGAAAGTGGCGAGTTCCGGATCCCTGCCTAGCGCGGCCCAACCTTTACTCCAGAG
ATCATGGCTGCCGAGGATGTGGTGGCGACTGGCGCCGACCCAAGCGATCTGGAGAGCGGCGGGCTGCTGCATGAG
ATTTTCACGTCGCCGCTCAACCTGCTGCTGCTTGGCCTCTGCATCTTCCTGCTCTACAAGATCGTGCGCGGGGAC
CAGCCGGCGGCCAGCGGCGACAGCGACGACGACGAGCCGCCCCCTCTGCCCCGCCTCAAGCGGCGCGACTTCACC
CCCGCCGAGCTGCGGCGCTTCGACGGCGTCCAGGACCCGCGCATACTCATGGCCATCAACGGCAAGGTGTTCGAT
GTGACCAAAGGCCGCAAATTCTACGGGCCCGAGGGGCCGTATGGGGTCTTTGCTGGAAGAGATGCATCCAGGGGC
CTTGCCACATTTTGCCTGGATAAGGAAGCACTGAAGGATGAGTACGATGACCTTTCTGACCTCACTGCTGCCCAG
CAGGAGACTCTGAGTGACTGGGAGTCTCAGTTCACTTTCAAGTATCATCACGTGGGCAAACTGCTGAAGGAGGGG
GAGGAGCCCACTGTGTACTCAGATGAGGAAGAACCAAAAGATGAGAGTGCCCGGAAAAATGATTAAAGCATTCAG
TGGAAGTATATCTATTTTTGTATTTTGCAAAATCATTTGTAACAGTCCACTCTGTCTTTAAAACATAGTGATTAC
AATATTTAGAAAGTTTTGAGCACTTGCTATAAGTTTTTTAATTAACATCACTAGTGACACTAATAAAATTAACTT
CTTAGAATGCATGATGTGTTTGTGTGTCACAAATCCAGAAAGTGAACTGCAGTGCTGTAATACACATGTTAATAC
TGTTTTTCTTCTATCTGTAGTTAGTACAGGATGAATTTAAATGTGTTTTTCCTGAGAGACAAGGAAGACTTGGGT
ATTTCCCAAAACAGGTAAAAATCTTAAATGTGCACCAAGAGCAAAGGATCAACTTTTAGTCATGATGTTCTGTAA
AGACAACAAATCCCTTTTTTTTCTCAATTGACTTAACTGCATGATTTCTGTTTTATCTACCTCTAAAGCAAATC
TGCAGTGTTCCAAAGACTTTGGTATGGATTAAGCGCTGTCCAGTAACAAAATGAAATCTCAAAACAGAGCTCAGC
TGCAAAAAAGCATATTTTCTGTGTTTCTGGACTGCACTGTTGTCCTTGCCCTCACATAGACACTCAGACACCCTC
ACAAACACAGTAGTCTATAGTTAGGATTAAAATAGGATCTGAACATTCAAAAGAAAGCTTTGGAAAAAAAGAGCT
GGCTGGCCTAAAAACCTAAATATATGATGAAGATTGTAGGACTGTCTTCCCAAGCCCCATGTTCATGGTGGGGCA
ATGGTTATTTGGTTATTTTACTCAATTGGTTACTCTCATTTGAAATGAGGGAGGGACATACAGAATAGGAACAGG
TGTTTGCTCTCCTAAGAGCCTTCATGCACACCCCTGAACCACGAGGAAACAGTACAGTCGCTAGTCAAGTGGTTT
TTAAAGTAAAGTATATTCATAAGGTAACAGTTATTCTGTTGTTATAAAACTATACCCACTGCAAAAGTAGTAGTC
AAGTGTCTAGGTCTTTGATATTGCTCTTTTGGTTAACACTAAGCTTAAGTAGACTATACAGTTGTATGAATTTGT
AAAAGTATATGAACACCTAGTGAGATTTCAAACTTGTAATTGTGGTTAAATAGTCATTGTATTTTCTTGTGAACT
GTGTTTATGATTTTACCTCAAATCAGAAAACAAAATGATGTGCTTTGGTCAGTTAATAAAAATGGTTTTACCCA
CTAAAAAAAAAAAAA
```

FIGURE 469

MAAEDVVATGADPSDLESGGLLHEIFTSPLNLLLLGLCIFLLYKIVRGDQPAASGDSDDDEPPPLPRLKRRDFTP
AELRRFDGVQDPRILMAINGKVFDVTKGRKFYGPEGPYGVFAGRDASRGLATFCLDKEALKDEYDDLSDLTAAQQ
ETLSDWESQFTFKYHHVGKLLKEGEEPTVYSDEEEPKDESARKND

FIGURE 470

```
AGCCATATGGGGGATACGCCAGCAACAGACGCCGGCCGCCAAGATCTGCATCCCTAGGCCACGCTAAGACCCTGG
GGAAGAGCGCAGGAGCCCGGGAGAAGGGCTGGAAGGAGGGGACTGGACGTGCGGAGAATTCCCCCCTAAAAGGCA
GAAGCCCCCGCCCCCACCCTCGAGCTCCGCTCGGGCAGAGCGCCTGCCTGCCTGCCGCTGCTGCGGGCGCCCACC
TCGCCCAGCCATGCCAGGCCCGGCCACCGACGCGGGAAGATCCCTTTCTGCGACGCCAAGGAAGAAATCCGTGC
CGGGCTCGAAAGCTCTGAGGGCGGCGGCGGCCCGGAGAGGCCAGGCGCGCGCGGGCAGCGGCAGAACATCGTCTG
GAGGAATGTCGTCCTGATGAGCTTGCTCCACTTGGGGGCCGTGTACTCCCTGGTGCTCATCCCCAAAGCCAAGCC
ACTCACTCTGCTCTGGGCCTACTTCTGCCTCCTCCTGGCCGCTCTGGGTGTGACAGCTGGTGCCCATCGCTTGTG
GAGCCACAGGTCCTACCGGGCCAAGCTGCCTCTGAGGATATTTCTGGCTGTCGCCAACTCCATGGCTTTCCAGAA
TGACATCTTCGAGCGGTCCAGGGACCACCGAGCCCACCACAAGTACTCAGAGACGGATGCTGACCCCCACAATGC
CCGCCGGGGCTTCTTCTTCTCCCATATTGGGTGGCTGTTTGTTCGCAAGCATCGAGATGTTATTGAGAAGGGGAG
AAAGCTTGACGTCACTGACCTGCTTGCTGATCCTGTGGTCCGGATCCAGAGAAATACACAGCACATCCAGAAAGA
AGGAAGAGCTCTCAATCAAGAGGCAGCGTGTGAGATGCTTCGTGAGTGGCATCAAGGGCATATATTGAAAGTCAC
CCTTCCCGGATTACACATTTTAGCTTTGTTACATACTCATTGTAACCACTCCGAAAAGTGCTGCTTGATGCTGCG
TGCTCTTTCTGTGTCCCTGGAGGTATTCTGAAGGTCAGAAGAGAGATATACAACAGCGAGGCTTGGTGATAACGT
ATAGAATAACAGACGGGGACTCCACACCCAGGCCTTTTTTAACGGTGTGAAGCATAGACAGAGCTGCAGTCTGTG
CTAACATTAGGTTATTTATTGATTCAATCAGTTGACACAAGGAGGCAGCTACGGGGAGGTAAAATATGGTCCTAA
AATCAAAAAGATTTCAGTTTTGTCATTCTGTCTCTGAGATTCTATTTCCACATCTAGAGCAGGGTAATAATGATA
CCTACCTTACAAAATTATTGGGAGAATACATTAGTTAATATATGTGAAAGTATGGAGGAGATGTGCAATAAATAT
TTGTGTTATTAACTACACATACAGCACTCTATAGGAGATATTCCATTTATAAAAACTTTAGGTTCTAAAAACCTG
TACACGTTGATTATTTTTGTAAGTCAAAAGTGATTAAGAGGAGTTTAAGCTATCATTTCCAGATGTATTTCTATA
AATAAAAACATAAGTATATTCAGTTGATTTGGGGTGGAGAGTTCCATAGATGTCTGTTAGGTCCGCTTGGTCCAG
AGCTGAGTTCAAGTCCTGAATATCCTTGTTAATTTTCTGTCTTGTTGATCTGTCTAATATTGACAGTGGGGTATT
AAAGTCTCCCACTATTATTATATGGGAGTCTAAGTCTCCTTGTAGGTCTCTAAGAACTTGCTTTATGAATCTGGG
TGCTCCTGTATTAGGTGCATACATATTTAGGATAGTTAGCTCTTCTTGCTGCATTGATCCCATTACCATTATATA
ATGCCCTTCTTTGTCTTTTTGATCTTTGTTGGTTTAAAGTCTGTTTTATTAGAGACTAGGATTGCAACCCCTGC
TATTTTTTTTTTTTTTTGCTTGATAAATATTCCTGTATCCCTTTATTTTGAGCCTATATGTGTCTTTGCACGT
GAGGTGGGTCTCCTGAATACAGCACACCGATGGGTTTTGACTCTAAAAAAAAAAAAAAAAAAAAAAAAAAAA
```

FIGURE 471

MPGPATDAGKIPFCDAKEEIRAGLESSEGGGGPERPGARGQRQNIVWRNVVLMSLLHLGAVYSLVLIPKAKPLTL
LWAYFCLLLAALGVTAGAHRLWSHRSYRAKLPLRIFLAVANSMAFQNDIFERSRDHRAHHKYSETDADPHNARRG
FFFSHIGWLFVRKHRDVIEKGRKLDVTDLLADPVVRIQRNTQHIQKEGRALNQEAACEMLREWHQGHILKVTLPG
LHILALLHTHCNHSEKCCLMLRALSVSLEVF

FIGURE 472

```
ATTCTGAGCCGAGCCCGGTGCCAAGCGCAGCTAGCTCAGCAGGCGGCAGCGGCGGCCTGAGCTTCAGGGCAGCCA
GCTCCTCCCGGTCTCGCCTTCCTCGCGGTCAGCATGAAAGCCTTCAGTCCCGTGAGGTCCGTTAGGAAAAACAGC
CTGTCGGACCACAGCCTGGGCATCTCCCGGAGCAAAACCCTGTGGACGACCCGATGAGCCTGCTATACAACATG
AACGACTGCTACTCCAAGCTCAAGGAGCTGGTGCCCAGCATCCCCCAGAACAAGAAGGTGAGCAAGATGGAAATC
CTGCAGCACCTCATCGACTACATCTTGGACCTGCAGATCGCCCTGGACTCGCATCCCACTATTGTCAGCCTGCAT
CACCAGAGACCCGGGCAGAACCAGCGCTCCAGGACGCCGCTGACCACCCTCAACACGGATATCAGCATCCTGTCC
TTGCAGGCTTCTGAATTCCCTTCTGAGTTAATGTCAAATGACAGCAAAGCACTGTGTGGCTGAATAAGCGGTGTT
CATGATTTCTTTTATTCTTTGCACAACAACAACAACAACAAATTCACGGAATCTTTTAAGTGCTGAACTTATTTT
TCAACCATTTCACAAGGAGGACAAGTTGAATGGACCTTTT
```

FIGURE 473

MKAFSPVRSVRKNSLSDHSLGISRSKTPVDDPMSLLYNMNDCYSKLKELVPSIPQNKKVSKMEILQHLIDYILDL
QIALDSHPTIVSLHHQRPGQNQRSRTPLTTLNTDISILSLQASEFPSELMSNDSKALCG

FIGURE 474

```
GGCTAGGTGCGCTGCGAGCGCGCGGAGCCACGAGGGCGGACGGACGTAATGGGCCCGCCTGGCCCTGGGCGCCGC
GCCGCACGAGCACCAGCCTAGAGCCAGGACTGAAGCTTCAAGATGGCTGACCAGGACCCTGCGGGCATCAGCCCC
CTCCAGCAAATGGTGGCCTCAGGCACCGGGGCTGTGGTTACCTCTCTCTTCATGACACCCCTGGACGTGGTGAAG
GTTCGCCTGCAGTCTCAGCGGCCCTCCATGGCCAGCGAGCTGATGCCTTCCTCCAGACTGTGGAGCCTCTCCTAT
ACCAAATGGAAGTGCCTCCTGTATTGCAATGGTGTCCTGGAGCCTCTGTACCTGTGCCCAAATGGTGCCCGCTGT
GCCACCTGGTTTCAAGACCCTACCCGCTTCACTGGCACCATGGATGCCTTCGTGAAGATCGTGAGGCACGAGGGC
ACCAGGACCCTCTGGAGCGGCCTCCCCGCCACCCTGGTGATGACTGTGCCAGCTACCGCCATCTACTTCACTGCC
TATGACCAACTGAAGGCCTTCCTGTGTGGTCGAGCCCTGACCTCTGACCTCTACGCACCCATGGTGGCTGGCGCG
CTGGCCCGCCTGGGCACCGTGACTGTGATCAGCCCCTGGAGCTTATGCGGACAAAGCTGCAGGCTCAGCATGTG
TCGTACCGGGAGCTGGGTGCCTGTGTTCGAACTGCAGTGGCTCAGGGTGGCTGGCGCTCACTGTGGCTGGGCTGG
GGCCCCACTGCCCTTCGAGATGTGCCCTTCTCAGCCCTGTACTGGTTCAACTATGAGCTGGTGAAGAGCTGGCTC
AATGGGTTCAGGCCGAAGGACCAGACTTCTGTGGGCATGAGCTTTGTGGCTGGTGGCATCTCAGGGACGGTGGCT
GCAGTGCTGACTCTACCCTTTGACGTGGTAAAGACCCAACGCCAGGTCGCTCTGGGAGCGATGGAGGCTGTGAGA
GTGAACCCCCTGCATGTGGACTCCACCTGGCTGCTGCTGCGGAGGATCCGGGCCGAGTCGGGCACCAAGGGACTC
TTTGCAGGCTTCCTTCCTCGGATCATCAAGGCTGCCCCTCCTGTGCCATCATGATCAGCACCTATGAGTTCGGC
AAAAGCTTCTTCCAGAGGCTGAACCAGGACCGGCTTCTGGGCGGCTGAAAGGGGCAAGGAGGCAAGGACCCCGTC
TCTCCCACGGATGGGGAGAGGGCAGGAGGAGACCCAGCCAAGTGCCTTTTCCTCAGCACTGAGGGAGGGGCTTG
TTTCCCTTCCCTCCCGGCGACAAGCTCCAGGGCAGGGCTGTCCCTCTGGGCGGCCCAGCACTTCCTCAGACACAA
CTTCTTCCTGCTGCTCCAGTCGTGGGGATCATCACTTACCCACCCCCCAAGTTCAAGACCAAATCTTCCAGCTGC
CCCCTTCGTGTTTCCCTGTGTTTGCTGTAGCTGGGCATGTCTCCAGGAACCAAGAAGCCCTCAGCCTGGTGTAGT
CTCCCTGACCCTTGTTAATTCCTTAAGTCTAAAGATGATGAACTTCAAAAAAAAAA
```

FIGURE 475

MADQDPAGISPLQQMVASGTGAVVTSLFMTPLDVVKVRLQSQRPSMASELMPSSRLWSLSYTKWKCLLYCNGVLE
PLYLCPNGARCATWFQDPTRFTGTMDAFVKIVRHEGTRTLWSGLPATLVMTVPATAIYFTAYDQLKAFLCGRALT
SDLYAPMVAGALARLGTVTVISPLELMRTKLQAQHVSYRELGACVRTAVAQGGWRSLWLGWGPTALRDVPFSALY
WFNYELVKSWLNGFRPKDQTSVGMSFVAGGISGTVAAVLTLPFDVVKTQRQVALGAMEAVRVNPLHVDSTWLLLR
RIRAESGTKGLFAGFLPRIIKAAPSCAIMISTYEFGKSFFQRLNQDRLLGG

FIGURE 476

```
CAAATCCGTGCTCCTAGATTTGCAGGTTCTGATACTGTGGTTCGAGCTACACTCGCCGCCTGGGCAGACACTCGT
CCAAACCACTGGAGTGTGCTGGTGATCGCAGCCAGCCCTTCGCCTCTCCATGAACCCGTGAGCCTGGGGCAGGTG
CCAGGCGATGGCGCGGCCTGTGAGCGACAGGACCCCGGCCCCTCTGCTGCTGGGCGGCCCGGCCGGGACACCCCC
TGGCGGGGGAGCGCTGCTTGGGTTGCGGAGCCTTCTGCAGGGGACCAGCAAGCCCAAAGAGCCGGCCAGCTGTCT
CCTGAAGGAAAAGGAGCGCAAGGCGGCCCTGCCTGCAGCCACAACCCCTGGGCCAGGCCTGGAGACTGCGGGCCC
GGCGGATGCCCCGGCTGGGGCAGTGGTGGGCGGAGGGTCCCCGCGGGGGCGCCCGGGGCCGGTGCCCGCCCCGGG
TCTGTTGGCGCCACTGCTGTGGGAGCGCACGCTGCCGTTCGGCGATGTGGAGTACGTAGACCTGGACGCCTTCCT
GCTGGAGCACGGGCTCCCGCCCAGCCCGGCGCCCCCGGTGGCCGGTCGCCGGAGCCGTCGCCCGCGCGGACGCC
CGCACCCTCCCCAGGGCCGGGTTCGTGCGGCTCGGCTTCCCCCCGCTCCTCTCCTGGGCACGCCCCGCCCGGGC
TGCCCTCGGGACCGCCACGGGCCACCGCGCAGGCCTGACCTCTCGGGACACACCCAGCCCTGTGGACCCAGACAC
CGTGGAGGTGTTGATGACCTTTGAACCCGACCCAGCTGATCTTGCCCTATCAAGCATTCCTGGCCACGAGACCTT
TGACCCTCGAAGACATCGCTTCTCAGAAGAGGAACTTAAGCCCCAGCCAATCATGAAGAAGGCAAGAAAAATCCA
GGTGCCGGAGGAGCAGAAGGATGAGAAATACTGGAGCCGGCGGTACAAGAACAACGAGGCAGCCAAGCGGTCCCG
TGACGCCCGGCGGCTCAAGGAGAACCAGATATCGGTGCGGGCGGCCTTCCTGGAGAAGGAGAACGCCCTGCTGCG
GCAGGAAGTTGTGGCCGTGCGCCAGGAGCTGTCCCACTACCGCGCCGTGCTGTCCCGATACCAGGCCCAGCACGG
GGCCCTGTGAGGCTGCCCCACATCCCCACCTGGCAGGCGTCTCCTCCGCTTGCTGAGACTTACGCCCTGTTCCCT
TCCTGCCCTGTGCCCACGGGCCGGCCAGCTGGGTGCCCCAGGGACGTGATAATGCAGATAAATACATTTATATTT
TTAAGAAAAAGCGAGCCTCCCCCCTCTTGCGGGGGCGGGGAGGGTTCTCTGTGTGTCCCCGGCACGTCAGGGACC
CTATCCTCCCACCGCCTCCGTTAACACGATCCTGAATAAATCTTGAGAACCCC
```

FIGURE 477

MARPVSDRTPAPLLLGGPAGTPPGGGALLGLRSLLQGTSKPKEPASCLLKEKERKAALPAATTPGPGLETAGPAD
APAGAVVGGGSPRGRPGPVPAPGLLAPLLWERTLPFGDVEYVDLDAFLLEHGLPPSPPPPGGPSPEPSPARTPAP
SPGPGSCGSASPRSSPGHAPARAALGTATGHRAGLTSRDTPSPVDPDTVEVLMTFEPDPADLALSSIPGHETFDP
RRHRFSEEELKPQPIMKKARKIQVPEEQKDEKYWSRRYKNNEAAKRSRDARRLKENQISVRAAFLEKENALLRQE
VVAVRQELSHYRAVLSRYQAQHGAL

FIGURE 478

CAAAACACCAAATGGCGGATGACGCCGGTGCAGCGGGGGGGCCCGGGGGCCCTGGTGGCCCTGGGATGGGGAACC
GCGGTGGCTTCCGCGGAGGTTTCGGCAGTGGCATCCGGGGCCGGGGTCGCGGCCGTGGACGGGGCCGGGGCCGAG
GCCGCGGAGCTCGCGGAGGCAAGGCCGAGGATAAGGAGTGGATGCCCGTCACCAAGTTGGGCCGCTTGGTCAAGG
ACATGAAGATCAAGTCCCTGGAGGAGATCTATCTCTTCTCCCTGCCCATTAAGGAATCAGAGATCATTGATTTCT
TCCTGGGGGCCTCTCTCAAGGATGAGGTTTTGAAGATTATGCCAGTGCAGAAGCAGACCCGTGCCGGCCAGCGCA
CCAGGTTCAAGGCATTTGTTGCTATCGGGGACTACAATGGCCACGTCGGTCTGGGTGTTAAGTGCTCCAAGGAGG
TGGCCACCGCCATCCGTGGGGCCATCATCCTGGCCAAGCTCTCCATCGTCCCCGTGCGCAGAGGCTACTGGGGGA
ACAAGATCGGCAAGCCCCACACTGTCCCTTGCAAGGTGACAGGCCGCTGCGGCTCTGTGCTGGTACGCCTCATCC
CTGCACCCAGGGGCACTGGCATCGTCTCCGCACCTGTGCCTAAGAAGCTGCTCATGATGGCTGGTATCGATGACT
GCTACACCTCAGCCCGGGCTGCACTGCCACCCTGGGCAACTTCGCCAAGGCCACCTTTGATGCCATTTCTAAGA
CCTACAGCTACCTGACCCCCGACCTCTGGAAGGAGACTGTATTCACCAAGTCTCCCTATCAGGAGTTCACTGACC
ACCTCGTCAAGACCCACACCAGAGTCTCCGTGCAGCGGACTCAGGCTCCAGCTGTGGCTACAACATAGGGTTTTT
ATACAAGAAAAATAAAGTGAATTAAGCGTGAAAAAAAAAAAAAAAAAAAAAAAAAAAAAAAAAAAAAAAAAAAAA
AAA

FIGURE 479

MADDAGAAGGPGGPGGPGMGNRGGFRGGFGSGIRGRGRGRGRGRGRGRGARGGKAEDKEWMPVTKLGRLVKDMKI
KSLEEIYLFSLPIKESEIIDFFLGASLKDEVLKIMPVQKQTRAGQRTRFKAFVAIGDYNGHVGLGVKCSKEVATA
IRGAIILAKLSIVPVRRGYWGNKIGKPHTVPCKVTGRCGSVLVRLIPAPRGTGIVSAPVPKKLLMMAGIDDCYTS
ARGCTATLGNFAKATFDAISKTYSYLTPDLWKETVFTKSPYQEFTDHLVKTHTRVSVQRTQAPAVATT

FIGURE 480

```
GATTTCAGTTGAAAGATGTGTTTTTGTGAGTAGAGCACCGCAGAAGAACTGAAGACTGTTGTGTGCTCCCCGCAG
AAGGGGCTACCATGATCCTTTCCTCCTATAACACCATCCAGTCGGTTTTCTGTTGCTGCTGTTGCTGTTCAGTGC
AGAAGCGACAAATGAGAACACAGATAAGCCTGAGCACAGATGAAGAGCTTCCAGAAAAATACACCCAGCATCGCA
GGCCGTGGCTCAGCCAATTGTCAAATAAGAAGCAATCCAACACGGGCCGTGTGCAGCCGTCAAAACGAAAGCCAC
TGCCTCCCCTCCCACCCTCTGAGGTTGCTGAAGAGAAGATCCAAGTCAAGGCACTTTATGATTTTCTGCCCAGAG
AACCCTGTAATTTAGCCTTAAGGAGAGCAGAAGAATACCTGATACTGGAGAAATACAATCCTCACTGGTGGAAGG
CAAGAGACCGTTTGGGGAATGAAGGCTTAATCCCAAGCAACTATGTGACTGAAAACAAAATAACTAATTTAGAAA
TATATGAGTGGTACCATAGAAACATTACCAGAAATCAGGCAGAACATCTATTGAGACAAGAGTCTAAAGAAGGTG
CATTTATTGTCAGAGATTCAAGACATTTAGGATCCTACACAATTTCCGTATTTATGGGAGCTAGAAGAAGTACGG
AGGCTGCCATAAAACATTATCAGATAAAAAAGAATGACTCAGGACAGTGGTATGTGGCTGAAAGACACGCCTTTC
AATCAATCCCTGAGTTAATCTGGTATCACCAGCACAATGCAGCCGGTCTCATGACTCGTCTCCGATATCCAGTTG
GGCTGATGGGCAGTTGTTTACCAGCCACAGCTGGGTTTAGCTACGAAAAGTGGGAGATAGATCCATCTGAGTTGG
CTTTTATAAAGGAGATTGGAAGCGGTCAGTTTGGAGTGGTCCATTTAGGTGAATGGCGGTCACATATCCAGGTAG
CTATCAAGGCCATCAATGAAGGCTCCATGTCTGAAGAGGATTTCATTGAAGAGGCCAAAGTGATGATGAAATTAT
CTCATTCAAAGCTAGTGCAACTTTATGGAGTCTGTATACAGCGGAAGCCCCTTTACATTGTGACAGAGTTCATGG
AAAATGGCTGCCTGCTTAACTATCTCAGGGAGAATAAAGGAAAGCTTAGGAAGGAAATGCTACTGAGTGTATGCC
AGGATATATGTGAAGGAATGGAATATCTGGAGAGGAATGGCTATATTCATAGGGATTTGGCGGCAAGGAATTGTT
TGGTCAGTTCAACATGCATAGTAAAAATTTCAGACTTTGGAATGACAAGGTACGTTTGGATGATGAGTATGTCA
GTTCTTTTGGAGCCAAGTTCCCAATCAAGTGGTCCCCTCCTGAAGTTTTTCTTTTCAATAAGTACAGCAGTAAAT
CTGATGTCTGGTCATTTGGAGTTTTAATGTGGGAAGTTTTTACAGAAGGAAAAATGCCTTTTGAAAATAAGTCAA
ATTTGCAAGTCGTGGAAGCTATTTCTGAAGGCTTCAGGCTATATCGCCCTCACCTGGCACCAATGTCCATATATG
AAGTCATGTACAGCTGCTGGCATGAGAAACCTGAAGGCCGCCCTACATTGCGGAGCTGCTGCGGGCTGTCACAG
AGATTGCGGAAACCTGGTGACCGGAAACAGAATGCCAACCCAAAGAGTCATCTTGCAAAACTGTCATTTATTGTG
AATATCTTCACCATATGGGGTCACTTATGGTGAATATCTTTCTTCAGAGTTGCTGACTCTTGAAAACAGTGCAAA
GATCACAGTTTTTAAAAGTTTTAAAAATTTAAGAATATTCACACAATCGTTTTTCTATGTGTGAGAGGGATTTGC
ACACTCTTATTTTTCTGTAAAATATTTCACATCCCAAATGTGAAGAAGTGAAAAAGACTTCGCAGCAGTCTTCAT
TGTGGTGCTCTTCATGATCATAGCCCCAGGAACCCTTGAGGTTCTTCTTCACAAGGCTGAGAGTGCTTCCTTCTT
GAAGACGAGTGTCATTCATCACTTCAGTGATCCATGCATAGAATATGAAAATAAATTCTTCCAACTCATGGGATA
AAGGGGACTCCCTTGAAGAATTTCATGTTTTTGGGCTGTATAGCTCTTTACAGAAAATGCACCTTTATAAATCAC
ATGAATGTTAGTATTCTGGAAATGTCTTTTGTTAATATAATCTTCCCATGTTATTTAACAAATTGTTTTTGCACA
TATCTGATTATATTGAAAGCAGTTTTTTGCATTCGAGTTTTAAACACTGTTATAAAATGTAGCCAAAGCTCACC
TTTGAACAGATCCCGGTGACATTCTATTTCCAGGAAAATCCGGAACCTGATTTTAGTTCTGTGATTTTACACTTTT
TTACATGTGAGATTGGACAGTTTCAGAGGCCTTATTTTGTCATACTAAGTGTCTCCTGTAATTTTCAGGAAGATG
ATTTGTTCTTTCCAGAAGAGGAGACAAAAGCAAGATAGCCAAATGTGACATCAAGCTCCATTGTTTCGGAAATCC
AGGATTTTGAATTC
```

FIGURE 481

MILSSYNTIQSVFCCCCCCSVQKRQMRTQISLSTDEELPEKYTQHRRPWLSQLSNKKQSNTGRVQPSKRKPLPPL
PPSEVAEEKIQVKALYDFLPREPCNLALRRAEEYLILEKYNPHWWKARDRLGNEGLIPSNYVTENKITNLEIYEW
YHRNITRNQAEHLLRQESKEGAFIVRDSRHLGSYTISVFMGARRSTEAAIKHYQIKKNDSGQWYVAERHAFQSIP
ELIWYHQHNAAGLMTRLRYPVGLMGSCLPATAGFSYEKWEIDPSELAFIKEIGSGQFGVVHLGEWRSHIQVAIKA
INEGSMSEEDFIEEAKVMMKLSHSKLVQLYGVCIQRKPLYIVTEFMENGCLLNYLRENKGKLRKEMLLSVCQDIC
EGMEYLERNGYIHRDLAARNCLVSSTCIVKISDFGMTRYVLDDEYVSSFGAKFPIKWSPPEVFLFNKYSSKSDVW
SFGVLMWEVFTEGKMPFENKSNLQVVEAISEGFRLYRPHLAPMSIYEVMYSCWHEKPEGRPTFAELLRAVTEIAE
TW

FIGURE 482A

```
CTGAACTAGTTGCCAGTGATCTTGAAACGTGACAGTAACCAAGAGATAAATAGGTGACAATGACAGGAAAATTAG
ATGTAGTAAAAGAGAGTGTTTGAGAGCAGAAGCTATGGCAACTAAAGACTGGATTTGAATCCTTCCTAGCTTGGT
GACATGAGCAAATTACTTGATTTAAGTGAGCATTTTCCCATCTGTACAGTGGAGATAACGATAATTGTGCCTGCT
AAGAAGAATTGCTGTGAAGATTAGTGAAATAATGCATGTAAAACATTTGGTACAGTATGTGACACATAGTACAAA
TAGTTTGCTAGGAAGATTGTTATTATTCTTCACTTGTGATATTGTGAAGTTTTCATACAGCAAATTGGACATCAT
GAGATGGATTGATTAAATAAATAGATTTGAACTTCAAGGACTGGTAGTGTTCTTGCTTTGGAAAGAAGAAACTTG
GTTTATCCTAATAATAGTAGGATAATAATGGTGAAGTGATAGGTACAAGTAATAGTGTTTATGATGCGCTGGTGA
TGATAGGAAAAGAAAGCCATTATATGGGCAAGAGCTAGAAGTAATAAAATGGTGCATTTTTCAGTGATGTTTGGC
CTATGTAGCTATTCTCTGATAACTATAAAAATCCTTATTATTGAAGATTCTTCAGGAAAAAAAAACCCTTAGTCT
GAAACTTAGCACCAATCCCCCTTGCCCCCCATTGAAATACGTATTTTTAAAACATGGCTTTTGATAATGTGAGG
GTTTTTTCCTTTTTGCGATTTAGCAGTGCTGATTGTGTATTGCAGTAGTTGTGAGAGCATTAGAAGCAGCAGTCG
ATAGGAGGATGGAAGGTCTGGATGCCGCCTTGGGGAGTTAGGAGATTGGCAGACTTACCCTGTACCACTCTAGCC
CTACTCCTTTGCCCAAGACAGAAACACACTGAGATGGATAGGAGAATATGAGCAGTTGATAGGAAAGTTCTCAGT
GGAGTCAGGATTTAGGTTAGGCCAGGAGATTGAGAATATAACAGTTTGTGTATGATGAAATGGCATATTTCACAG
AATGCAGTAAAAGCAGGTAGGGTACAAGTGCAGCAACAGGAAGATGTCTTTTCTTCATTCAGCAAACACTTATTT
GAGAGCTTACCATGTGCTAGGCACATACAAAGATAAATAAGATGCCCTTGATGATCCTCTATTTAAAGGAGACAT
GTAAACAGGTTAACTTAGAGTAGAGATGGTGAATATGTGAACCTGAGGAAAGGAAGAAATAGATTAAATTATCTG
GAGAGAGAGGAAAAGTCAGCAGAATGGGGACGAGAATCTTTCGGAGCTCAGTGTTCTGATAGGAGTTATTTCCTT
GGGCATAGGTTCCAAGTATTTTTCTAATATACCATAGAAGCCAGGAAAACTTTCTTCTGTTATCTCAAATGATTT
AATTACTGACTTGAGTTTGTGTTGTCTCCTTAGACTTGTGCACCATGGACAATTTTGCTGAGGGAGATTTCACTG
TGGCGGATTATGCCTTGTTAGAAGATTGCCCTCACGTGGATGATTGTGTCTTTGCTGCTGAATTTATGAGCAATG
ATTATGTTCGTGTGACTCAGCTTTACTGTGATGGGTGGGTGTGCAATATAAAGATTATATCCAAAGTGAGAGGA
ATTTGGAATTTGACATCTGCAGTATATGGTGTAGTAAACCAATTTCTGTCCTGCAAGATTATTGCGATGCCATTA
AAATAAACATCTTCTGGCCACTTCTGTTTCAACATCAAAACAGTTCCGTAATATCACGATTGCATCCCTGTGTGG
ACGCCAACAATTCACGTGCTTCTGAGATAAATTTGAAGAAACTACAACATCTTGAGTTGATGGAAGATATTGTGG
ATTTGGCAAAGAAAGTTGCTAATGATTCATTCCTTATTGGAGGCTTATTGAGAATTGGTTGTAAAATAGAAATA
AAATCTTGGCAATGGAAGAAGCTCTGAATTGGATAAAATATGCAGGCGATGTAACAATTCTAACTAAATTAGGAT
CAATTGACAATTGTTGGCCTATGTTAAGTATTTTCTTTACTGAATACAAGTACCACATAACTAAAATTGTAATGG
AAGACTGCAATTTGCTTGAAGAACTTAAAACTCAAAGTTGTATGGATTGTATAGAGGAAGGAGAACTAATGAAAA
TGAAAGGAAATGAAGAGTTTTCCAAAGAAAGATTTGATATAGCTATTATCTATTACACCAGAGCCATTGAATATA
GACCTGAAAACTACCTTCTTTATGGTAACCGAGCTCTTTGTTTTCTTCGTACTGGACAGTTTAGAAATGCACTCG
GTGATGGAAAGAGAGCCACTATTCTGAAGAACACTTGGCCAAAGGGTCATTATCGTTATTGTGATGCTCTTTCTA
TGCTGGGGGAATATGACTGGGCCCTGCAAGCAAACATAAAAGCTCAAAAACTCTGTAAAAATGACCCTGAGGGAA
TCAAGGATCTAATTCAGCAGCATGTAAAGTTACAAAAACAAATAGAAGACCTACAAGGTCGAACAGCAAATAAGG
ATCCAATTAAAGCCTTTTATGAAAACAGGGCCTACACACCTAGGAGTTTATCAGCACCTATATTTACTACTTCAC
TTAACTTTGTGGAGAAGGAAAGAGATTTCAGAAAAATTAATCACGAAATGGCCAACGGTGGTAATCAGAATCTAA
AGGTGGCGGATGAGGCGTTGAAGGTAGATGATTGTGACTGTCATCCTGAATTTTCACCACCATCAAGTCAGCCTC
CAAAACATAAAGGAAAACAAAAATCTCGAAACAATGAATCAGAAAAGTTCAGTTCTAGTTCACCATTGACTTTAC
CAGCAGATTTGAAGAACATCTTGGAGAAACAGTTTTCTAAATCTTCCAGAGCTGCACACCAGGATTTTGCTAATA
TAATGAAAATGCTGAGAAGCTTAATTCAAGATGGCTATATGGCCTTATTGGAGCAGCGTTGCCGCAGCGCTGCAC
AGGCCTTTACAGAGTTGCTGAACGGTTTAGATCCTCAAAAAATAAAGCAATTGAACCTGGCCATGATTAACTATG
TTTTGGTCGTCTATGGACTTGCCATTTCTCTCCTTGGAATAGGACAGCCTGAGGAATTATCTGAAGCCGAAACC
AGTTTAAGAGGATTATTGAACACTACCCCAGTGAGGGCCTTGATTGCTTGGCCTACTGTGGAATTGGAAAAGTGT
ATTTGAAAAAAAACAGATTTCTAGAAGCTCTCAATCACTTTGAGAAAGCAAGAACCTTGATTTATCGTCTTCCTG
GAGTGTTAACTTGGCCCACGAGTAATGTGATTATTGAAGAGTCTCAGCCACAAAAAATAAAGATGCTGTTAGAGA
AATTTGTTGAAGAATGCAAGTTCCCTCCAGTGCCAGATGCCATTTGTTGCTATCAGAAGTGCCATGGATATTCTA
AGATCCAGATATACATAACTGATCCAGACTTTAAGGGTTTTATACGCATCAGCTGTTGCCAGTACTGTAAAATAG
AATTTCACATGAATTGCTGGAAGAAGTTAAAAACTACAACCTTTAATGATAAAATTGACAAGGATTTTCTACAAG
```

FIGURE 482B

```
GAATATGTCTTACCCCTGACTGTGAAGGTGTCATTTCTAAGATTATCATCTTCAGCAGTGGTGGTGAAGTTAAAT
GTGAATTTGAACACAAGGTCATAAAAGAAAAGGTTCCTCCAAGACCTATTCTGAAACAGAAATGTTCTAGCCTAG
AGAAACTAAGACTGAAAGAAGACAAAAAATTGAAGAGAAAGATCCAAAAAAAAGAAGCAAAAAAGTTAGCACAAG
AAAGAATGGAGGAGGACTTAAGAGAAAGTAATCCACCCAAAAATGAAGAGCAGAAAGAAACTGTAGACAATGTTC
AGCGTTGTCAGTTCCTTGATGACAGAATTCTACAGTGTATAAAGCAGTATGCTGACAAGATTAAATCCGGCATAC
AGAATACAGCCATGCTTCTCAAAGAATTGCTTTCTTGGAAAGTTTTGAGCACAGAAGACTATACAACCTGTTTTT
CTAGCAGAAATTTTCTAAATGAAGCAGTGGACTATGTTATTCGCCACTTGATTCAAGAAAATAACAGAGTAAAGA
CAAGAATATTTCTGCATGTTTTGAGTGAGCTTAAAGAAGTGGAGCCCAAATTAGCCGCCTGGATCCAAAAACTTA
ATAGCTTTGGCTTAGATGCCACAGGAACTTTCTTTTCTCGTTATGGAGCATCTCTTAAACTGCTTGATTTTAGTA
TCATGACTTTCCTCTGGAATGAGAAATATGGTCACAAACTAGACTCTATAGAAGGAAAGCAACTTGATTATTCT
CTGAGCCAGCATCATTGAAGGAAGCCCGTTGTTTAATATGGCTGCTAGAAGAACACAGAGACAAGTTCCCAGCAT
TGCATAGTGCTTTAGATGAATTCTTTGATATAATGGACAGCCGCTGTACTGTGTTAAGGAAACAAGATAGTGGTG
AAGCACCGTTTAGTTCAACCAAGGTGAAAAACAAAAGCAAGAAAAAGAAGCCAAAGGATTCAAAGCCTATGTTAG
TTGGGTCTGGAACAACTTCAGTAACTTCAAATAATGAGATCATCACTTCAAGTGAAGACCATAGCAATCGAAATT
CAGATTCTGCAGGCCCATTTGCAGTGCCTGACCATCTTCGGCAAGATGTAGAAGAATTCGAAGCTCTCTATGACC
AACACAGTAACGAATATGTTGTCCGCAATAAGAAGCTATGGGACATGAACCCAAAACAAAAATGTTCAACTCTAT
ATGATTACTTCTCTCAGTTTTTGGAGGAACATGGTCCCTTGGACATGAGTAACAAGATGTTCTCTGCAGAATATG
AGTTTTTCCCAGAAGAAACTCGACAGATACTAGAAAAGCAGGAGGTTTAAAACCTTTCTCTTGGGATGCCCTC
GTTTTGTTGTGATTGACAACTGTATTGCACTGAAGAAGGTTGCATCACGGCTCAAGAAAAAAAGGAAGAAGAAAA
ACATTAAAACAAAAGTAGAAGAAATTTCAAAAGCAGGGGAGTATGTACGAGTTAAACTACAACTGAATCCAGCTG
CTAGGGAATTTAAACCAGATGTAAAGTCTAAACCAGTGTCAGATTCATCTTCAGCACCAGCTTTTGAAAATGTGA
AACCCAAACCTGTGTCTGCAAATTCTCCCAAGCCAGCTTGTGAAGATGTGAAGGCCAAACCAGTATCCGACAATT
CTTCTAGACAAGTTTCTGAGGATGGGCAACCCAAAGGGGTCTCTTCTAATTCTCCTAAACCAGGCTCTGAGGATG
CAAATTACAAGCGAGTCTCCTGTAATTCCCCAAACCGGTTCTTGAGGATGTGAAACCAACTTATTGGGCTCAAT
CCCATTTGGTCACAGGATACTGTACGTATCTTCCTTTCCAGAGATTTGATATCACCCAGACACCGCCAGCATACA
TAAACGTGTTACCAGGTTTGCCCCAGTACACCAGCATATATACACCCTTGGCCAGCCTTTCTCCTGAATATCAGC
TACCAAGATCAGTACCAGTGGTGCCGTCTTTTGTAGCCAATGACAGAGCAGATAAAAATGCTGCTGCCTATTTG
AGGGTCATCATTTGAATGCTGAGAATGTTGCTGGTCACCAGATTGCCTCTGAAACACAGATCCTTGAGGGCTCTT
TGGGAATATCTGTAAAGTCACACTGCAGCACAGGTGATGCTCATACAGTCCTGAGTGAGTCTAACAGAAATGATG
AGCACTGTGGAAATTCTAACAACAAATGTGAAGTAATTCCAGAAAGCACCAGTGCAGTAACAAACATTCCACACG
TGCAGATGGTTGCCATACAGGTATCTTGGAACATAATACACCAAGAAGTCAATACTGAGCCATATAATCCTTTG
AGGAACGACAAGGGGAAATTTCACGGATTGAAAAGGAGCACCAAGTATTACAAGACCAACTTCAAGAAGTGTATG
AAAATTATGAGCAGATAAAACTTAAGGGCTTAGAAGAGACCAGGGACCTGGAAGAGAAGTTGAAAAGGCACTTAG
AAGAAAACAAGATCTCAAAGACGGAATTAGATTGGTTCCTTCAAGATTTGGAAAGAGAAATTAAAAAATGGCAAC
AGGAAAAAAAAGAAATCCAAGAAAGACTAAAATCACTGAAGAAGAAAATTAAAAAGGTTTCAAATGCCAGTGAAA
TGTATACCCAGAAAAATGATGGAAAGGAAAAGGAACATGAATTACATCTGGATCAGTCCCTTGAAATCAGCAACA
CACTTACAAATGAGAAAATGAAAATAGAAGAGTATATAAAGAAAGGGAAGAGGATTATGAAGAGAGTCATCAGA
GAGCTGTGGCTGCAGAGGTATCCGTACTTGAAAACTGGAAGGAGAGTGAAGTGTATAAGCTACAGATCATGGAGT
CACAAGCAGAAGCCTTTCTGAAGAAGCTGGGGCTGATTAGCCGTGATCCTGCAGCATATCCTGACATGGAGTCTG
ATATACGTTCATGGGAATTGTTTCTTTCTAATGTTACAAAAGAAATTGAGAAAGCAAAGTCTCAGTTTGAAGAAC
AAATTAAGGCAATTAAAAATGGTTCTCGGCTCAGTGAACTTTCTAAAGTGCAGATTTCTGAGCTTTCATTTCCTG
CCTGTAACACGGTCATCCCGAGTTACTCCCTGAGTCTTCAGGCCACGATGGCCAAGGGCTTGTGACTTCTGCAA
GCGACGTGACTGGAAACCACGCAGCACTTCACAGGGATCCTAGTGTGTTCTCTGCTGGTGATTCCCCAGGGGAGG
CTCCTTCTGCGCTGTTGCCAGGGCCACCCCCTGGTCAGCCTGAAGCCACTCAGCTGACAGGGCCAAAACGGGCTG
GCCAGGCAGCTCTGTCAGAACGAAGCCCTGTGGCTGATCGGAAGCAGCCTGTTCCTCCAGGACGTGCTGCGCGTT
CAAGCCAGTCTCCAAAAAAGCCGTTCAATAGTATTATTGAGCACCTGTCAGTGGTATTCCCATGTTACAACAGCA
CTGAGCTTGCTGGTTTTATTAAAAAAGTGCGAAGCAAAAACAAGAACTCACTCTCAGGATTGAGTATTGATGAAA
TTGTCCAAAGAGTGACAGAACACATTCTAGATGAACAGAAAAAGAAAAAGCCAAACCCAGGAAAGGACAAGAGGA
```

FIGURE 482C

```
CTTATGAGCCCAGCTCTGCCACCCCCGTGACCAGGTCCTCCCAGGGCTCACCCTCGGTGGTTGTTGCACCATCAC
CCAAAACCAAGGGGCAGAAAGCAGAAGATGTCCCTGTGAGGATTGCACTGGGTGCAAGTTCCTGTGAAATATGCC
ACGAGGTGTTCAAATCAAAAAACGTGCGTGTGCTCAAATGTGGGCACAAGTATCACAAAGGGTGCTTTAAGCAGT
GGCTTAAAGGGCAGAGCGCTTGCCCGGCCTGCCAGGGTCGTGATCTCCTGACAGAAGAGTCACCTTCTGGAAGAG
GCTGGCCCAGTCAGAATCAGGAGCTGCCTTCCTGCTCTTCTAGGTAGTCACACTTCACTAAAGTGTCATCCACCA
GTGTGTTGAATCCGAAGAATGACAATTTTCTACCACTGGTGTAAAAAACAAACATTTGAAGACCCTTGTGCATTG
TGTGTCACAAAGCTAAATACATGGAAATCGTTAATATCGCTGATATTAAGTAATTTCCCCACTCTGAGTGAATAC
TTTGATGATTGCCAACAGTGGCTAATAAAATGACGGCTACCACACTCATGGGTCACTGGGGCTGCGCAGGGCTCT
TTGAGGTGGGTGGCTTCTTTTGGAAAGTACTATGAACGTCTCGAAGCAGTATTCTAGTGATAAGAATTCTTAACA
TAGCCAAGCGCCCCACGTTTGTTCCCCACGTTTGTTCCCCTTTTCTGTTTGAAAAACCTGTTCTGGTAGCTCCAC
AAGAGAGATGATACTGACTTTTTAAATTTTTTACAAGAGTCTGTATTCCTGATATGCCTATATTTTCCTCAAAG
ATTCTGCATTTTAAGGATGGGCATAAGCAAACTATATTTAATAATTTATAGTTAATGTTAAAATATTGGCTGAT
TTAGACCAAAAGATTCAAATCTCCTCTTTGTGAAATCCCATCTGCATTTGATTTTTATTATTTTATGTTCCCCC
GTTAGATTGTTTTAAGTGTTTGCTTTTCATCTTTTATAGATGTAATCTGATTTTCAAAAATCATTAACACTTTTT
AATTAGTATCGACTAAGACTTTTTCCCCCTGGAATCGAGGCTGTGTGTCCGTCATCCCAGCCCCCGGTTGGAGCC
TGCTCTTTGAACTCCGCTGCCTTCCTTAGCAGCTTCTGTCCTCTTCTGTGAGTCAGTCAGCGAGTGCTTGGGATC
CGCATCCAGCCGTGCTGAGCACACAACAGGCTGTGTGTGGAAATGGCCACCACCATTCTCCTTCCCCACCCCACC
ACAAAAAGAGAAGCTGTGTCTTTAGACAACCCTGAGGTATCTGTGTTACAATCGTTCTGTGTTTGATATTTGTGT
AAAGTATGCATGCAGTCTTGTACTGTGACCTAAGAACAAAACTGTAACTGCATTAGAAACCATGAAAAAATTAGA
TATTGTTTGTGACTTTTAGACAGTGGTAAATATAGAACCATGAATTCTGGTCACATTCCATTTCTCTCCAACAT
GAAGGATCAAAAAATGTTTTTCAATGTGTTCTTTGTTCCACTGGAAACTTAGAGTCATGAGTTTATGAGCTGATT
TGGTCACCTTCCTCTGCCTTTGTTCACTGTGAGTTCTGATGTCTTAGTGACTTAGTTCTTAGAAGCTCACGCCTT
AGTTTGAAACAGATTCTCCACGGTGGTCCCCAAAACACTGTCTGCATATCCATAAGAATTGAGCGCTATGGGTGT
TAACGTGCATGAGGATCAGTTTGCAGCAGCAAGTACAAAAGGAGAAGAGGAACATCCGTTGAATGAGTGTGTTTT
GTACATAACTTCAGATACTTGTGAACATGCCTTATATTTGTCCAACAACTGTCAGAATAAAGAACATTCTAAAAT
GAG
```

FIGURE 483

MDNFAEGDFTVADYALLEDCPHVDDCVFAAEFMSNDYVRVTQLYCDGVGVQYKDYIQSERNLEFDICSIWCSKPI
SVLQDYCDAIKINIFWPLLFQHQNSSVISRLHPCVDANNSRASEINLKKLQHLELMEDIVDLAKKVANDSFLIGG
LLRIGCKIENKILAMEEALNWIKYAGDVTILTKLGSIDNCWPMLSIFFTEYKYHITKIVMEDCNLLEELKTQSCM
DCIEEGELMKMKGNEEFSKERFDIAIIYYTRAIEYRPENYLLYGNRALCFLRTGQFRNALGDGKRATILKNTWPK
GHYRYCDALSMLGEYDWALQANIKAQKLCKNDPEGIKDLIQQHVKLQKQIEDLQGRTANKDPIKAFYENRAYTPR
SLSAPIFTTSLNFVEKERDFRKINHEMANGGNQNLKVADEALKVDDCDCHPEFSPPSSQPPKHKGKQKSRNNESE
KFSSSSPLTLPADLKNILEKQFSKSSRAAHQDFANIMKMLRSLIQDGYMALLEQRCRSAAQAFTELLNGLDPQKI
KQLNLAMINYVLVVYGLAISLLGIGQPEELSEAENQFKRIIEHYPSEGLDCLAYCGIGKVYLKKNRFLEALNHFE
KARTLIYRLPGVLTWPTSNVIIEESQPQKIKMLLEKFVEECKFPPVPDAICCYQKCHGYSKIQIYITDPDFKGFI
RISCCQYCKIEFHMNCWKKLKTTTFNDKIDKDFLQGICLTPDCEGVISKIIIFSSGGEVKCEFEHKVIKEKVPPR
PILKQKCSSLEKLRLKEDKKLKRKIQKKEAKKLAQERMEEDLRESNPPKNEEQKETVDNVQRCQFLDDRILQCIK
QYADKIKSGIQNTAMLLKELLSWKVLSTEDYTTCFSSRNFLNEAVDYVIRHLIQENNRVKTRIFLHVLSELKEVE
PKLAAWIQKLNSFGLDATGTFFSRYGASLKLLDFSIMTFLWNEKYGHKLDSIEGKQLDYFSEPASLKEARCLIWL
LEEHRDKFPALHSALDEFFDIMDSRCTVLRKQDSGEAPFSSTKVKNKSKKKKPKDSKPMLVGSGTTSVTSNNEII
TSSEDHSNRNSDSAGPFAVPDHLRQDVEEFEALYDQHSNEYVVRNKKLWDMNPKQKCSTLYDYFSQFLEEHGPLD
MSNKMFSAEYEFFPEETRQILEKAGGLKPFLLGCPRFVVIDNCIALKKVASRLKKKRKKKNIKTKVEEISKAGEY
VRVKLQLNPAAREFKPDVKSKPVSDSSSAPAFENVKPKPVSANSPKPACEDVKAKPVSDNSSRQVSEDGQPKGVS
SNSPKPGSEDANYKRVSCNSPKPVLEDVKPTYWAQSHLVTGYCTYLPFQRFDITQTPPAYINVLPGLPQYTSIYT
PLASLSPEYQLPRSVPVVPSFVANDRADKNAAAYFEGHHLNAENVAGHQIASETQILEGSLGISVKSHCSTGDAH
TVLSESNRNDEHCGNSNNKCEVIPESTSAVTNIPHVQMVAIQVSWNIIHQEVNTEPYNPFEERQGEISRIEKEHQ
VLQDQLQEVYENYEQIKLKGLEETRDLEEKLKRHLEENKISKTELDWFLQDLEREIKKWQQEKKEIQERLKSLKK
KIKKVSNASEMYTQKNDGKEKEHELHLDQSLEISNTLTNEKMKIEEYIKKGKEDYEESHQRAVAAEVSVLENWKE
SEVYKLQIMESQAEAFLKKLGLISRDPAAYPDMESDIRSWELFLSNVTKEIEKAKSQFEEQIKAIKNGSRLSELS
KVQISELSFPACNTVHPELLPESSGHDGQGLVTSASDVTGNHAALHRDPSVFSAGDSPGEAPSALLPGPPPGQPE
ATQLTGPKRAGQAALSERSPVADRKQPVPPGRAARSSQSPKKPFNSIIEHLSVVFPCYNSTELAGFIKKVRSKNK
NSLSGLSIDEIVQRVTEHILDEQKKKKPNPGKDKRTYEPSSATPVTRSSQGSPSVVVAPSPKTKGQKAEDVPVRI
ALGASSCEICHEVFKSKNVRVLKCGHKYHKGCFKQWLKGQSACPACQGRD

FIGURE 484

GTCAGGGATCCTAGGGGGTTCCGTGACTCTCCCCCTAAACATCTCAGTAGACACAGAGATTGAGAACGTCATCTG
GATTGGTCCCAAAAATGCTCTTGCTTTCGCACGTCCCAAAGAAAATGTAACCATTATGGTCAAAAGCTACCTGGG
CCGACTAGACATCACCAAGTGGAGTTACTCCCTGTGCATCAGCAATCTGACTCTGAATGATGCAGGATCCTACAA
AGCCCAGATAAACCAAAGGAATTTTGAAGTCACCACTGAGGAGGAATTCACCCTGTTCGTCTATGAGCAGCTGCA
GGAGCCCCAAGTCACCATGAAGTCTGTGAAGGTGTCTGAGAACTTCTCCTGTAACATCACTCTAATGTGCTCCGT
GAAGGGGGCAGAGAAAAGTGTTCTGTACAGCTGGACCCCAAGGGAACCCCATGCTTCTGAGTCCAATGGAGGCTC
CATTCTTACCGTCTCCCGAACACCATGTGACCCAGACCTGCCATACATCTGCACAGCCCAGAACCCCGTCAGCCA
GAGAAGCTCCCTCCCTGTCCATGTTGGGCAGTTCTGTACAGATCCAGGAGCCTCCAGAGGAGGAACAACGGGGGA
GACTGTGGTAGGGGTCCTGGGAGAGCCAGTCACCCTGCCACTTGCACTCCCAGCCTGCCGGGACACAGAGAAGGT
TGTCTGGTTGTTTAACACATCCATCATTAGCAAAGAGAGGGAAGAAGCAGCAACGGCAGATCCACTCATTAAATC
CAGGGATCCTTACAAGAACAGGGTGTGGGTCTCCAGCCAGGACTGCTCCCTGAAGATCAGCCAGCTGAAGATAGA
GGACGCCGGCCCCTACCATGCCTACGTGTGCTCAGAGGCCTCCAGCGTCACCAGCATGACACATGTCACCCTGCT
CATCTACCGACCTGAGAGAAACACAAAGCTTTGGATTGGGTTGTTCCTGATGGTTTGCCTTCTGTGCGTTGGGAT
CTTCAGCTGGTGCATTTGGAAGCGAAAAGGACGGTGTTCAGTCCCAGCCTTCTGTTCCAGCCAAGCTGAGGCCCC
AGCGGATACACCAGGATATGAGAAGCTGGACACTCCCCTCAGACAGCCCATCAGTGGAAGATATGAGGTATTTGA
CCAGGTCACTCAGGAGGGCGCTGGACATGACCCAGCCCCTGAGGGCCAAGCAGACTATGATCCCGTCACTCCATA
TGTCACGGAAGTTGAGTCTGTGGTTGGAGAGAACACCATGTATGCACAAGTGTTCAACTTACAGGGAAAGACCCC
AGTTTCTCAGAAGGAAGAGAGCTCAGCCACAATCTACTGCTCCATACGGAAACCTCAGGTGGTGCCACCACCACA
ACAGAATGATCTTGAGATTCCTGAAAGTCCTACCTATGAAAATTTCACCTGAAAGGAAAAGCAGCTGCTGCCTCT
CTCCTGGGACCGTGGGGTTGGAAAGTCAGCTGGACCTCATGGGGCCTGGGGCTCACAGACAGAAGCACCTCAGAA
TTTCCTTCAGTGCCTCAGAGATGCCTGGATGTGGCCCCTCCCCCTCCTTCTCACCCTTAAGGACTCCCAAACCCA
TTAATAGTTCAGACACAGGCTCCTTCTTGGAGCCTATGGGCTTCAGATGTCTTTGCCCCATTTGTCACCTCGCAC
ACTTATAGCGTTTCCTCCTCGAAATTCTACCAAGACTGGTCAAATGTTGCTGAGGGGCCTGGACCAGCTGTCCTT
TACACCACCTTCTCAACACTGCTGAAAAGAACCCAAGAGAATTGTCACACATGACACAAGATGTACATAATATCA
TGCTCACTGCAGTGTTATTTAAAATAAAAGGCAGGAAATAAACAAAA

FIGURE 485

MVKSYLGRLDITKWSYSLCISNLTLNDAGSYKAQINQRNFEVTTEEEFTLFVYEQLQEPQVTMKSVKVSENFSCN
ITLMCSVKGAEKSVLYSWTPREPHASESNGGSILTVSRTPCDPDLPYICTAQNPVSQRSSLPVHVGQFCTDPGAS
RGGTTGETVVGVLGEPVTLPLALPACRDTEKVVWLFNTSIISKEREEAATADPLIKSRDPYKNRVWVSSQDCSLK
ISQLKIEDAGPYHAYVCSEASSVTSMTHVTLLIYRPERNTKLWIGLFLMVCLLCVGIFSWCIWKRKGRCSVPAFC
SSQAEAPADTPGYEKLDTPLRQPISGRYEVFDQVTQEGAGHDPAPEGQADYDPVTPYVTEVESVVGENTMYAQVF
NLQGKTPVSQKEESSATIYCSIRKPQVVPPPQQNDLEIPESPTYENFT

FIGURE 486

ACATTTGCTTCTGACACAACTGTGTTCACTAGCAACCTCAAACAGACACCATGGTGCACCTGACTCCTGAGGAGA
AGTCTGCCGTTACTGCCCTGTGGGGCAAGGTGAACGTGGATGAAGTTGGTGGTGAGGCCCTGGGCAGGCTGCTGG
TGGTCTACCCTTGGACCCAGAGGTTCTTTGAGTCCTTTGGGGATCTGTCCACTCCTGATGCTGTTATGGGCAACC
CTAAGGTGAAGGCTCATGGCAAGAAAGTGCTCGGTGCCTTTAGTGATGGCCTGGCTCACCTGGACAACCTCAAGG
GCACCTTTGCCACACTGAGTGAGCTGCACTGTGACAAGCTGCACGTGGATCCTGAGAACTTCAGGCTCCTGGGCA
ACGTGCTGGTCTGTGTGCTGGCCCATCACTTTGGCAAAGAATTCACCCCACCAGTGCAGGCTGCCTATCAGAAAG
TGGTGGCTGGTGTGGCTAATGCCCTGGCCCACAAGTATCACTAAGCTCGCTTTCTTGCTGTCCAATTTCTATTAA
AGGTTCCTTTGTTCCCTAAGTCCAACTACTAAACTGGGGGATATTATGAAGGGCCTTGAGCATCTGGATTCTGCC
TAATAAAAAACATTTATTTTCATTGC

FIGURE 487

MVHLTPEEKSAVTALWGKVNVDEVGGEALGRLLVVYPWTQRFFESFGDLSTPDAVMGNPKVKAHGKKVLGAFSDG
LAHLDNLKGTFATLSELHCDKLHVDPENFRLLGNVLVCVLAHHFGKEFTPPVQAAYQKVVAGVANALAHKYH

FIGURE 488

ACTGCAGCAGGAGCATGTCCCTTTAAGCACAGATCACTGCAACTATTGTTTGTGGTTTAAGAATGCCTTTAAGCA
GTTTTCCACCCCCAGGCAGGCCCAGGTGTTCTTTGCCCTCATTCCCAGTAAACCCACAACCTTCCAGCATGGGTG
TTAGGGCCATTATGAACATGTTACAGTGCTGCAGAGATTTTATTTATGGCCAGTTTATGGCCAGATTTTGGGGGG
CCTGCTCCCAACACTCTACATATGCTCCATCTTGCAGAGGCTTCATTCTTGGTTCTCTAGCTAAAAACAGTAGAA
ATTTTGCACACCTGGGTTAGAAAAAAAAAATAGCCATTAAACCCACCCCTGTTACAGGTCACTATTGGTATTTTG
ATTTTGCCTTCAATCCATCTGTTATTGTTTACTTTTAAGAGTCCTTGATAGTTGCTTTTTATGTCCAGAGTTTTA
ATTTCAGTCAGAAAGAGAAATAGGCCTTGGTGAGCATGCTTTGTCTTGGCTGGTGCCAGAAGTCTGTACTCAAAT
ATTTTAAAAATAATTTTTAGTTGAATAACAAGTTAGACCTGTGTTTAGCTTTCTCATTGTTTTCCTAAAAATAGA
AGAAAAGGTTTTAAATACTTTAACCACGAAATACTTTAAAGCAGGTTTAAAATAAACTCCTTCATTTTGCCTGTT
CTATTACTCTGTTCTCACACTGCTAATAAAGACATACCCAAGACTGGTAATTTATAAAGTAAAGAGGTTTAATTG
ACTCACAGTTCCACATGGCTGGGGGAGGCCTCCCAATCATGGGCAGAAGGTGAATGAGGAGCAGAGTTACAACTT
ACATGGTGGCAGGCAAGAGAGAGAGCATGTGTGCAGGGGAATTCCCCCTTTATAAAACCGTCCCAATCTCATGAG
ACTTATGCAGTCTCATGGGAGCAGCATGAGAAAGACCTCACCTCCGTGATTCAGTTACCTCCCACTGTGTCCCTG
CCACAACATGTGGGAATTGTGGGAGCTAAAAATCAAGATGAGATTTGGGTAGGAACACAGTCAAACCACATCTCC
TATATACATTCACACTAGCATTTTAGTTTTAGAACTAGTTCTATGTTACTATCTGAATTAATTTTTCCACAATTT
TGTAAGGAAAATAATGCGTTCTTTGAATTTCATGTGTAAATGATATTTTTAGTTTTGTGTCATTTGTCAAATA
AATTCTGAAAATCTTTGTATTGACAGTGTGTTATCTCTGCATAACCATATATGTATAAGAGTGCTCAATAAAAAG
AATAAAGAGGAAACAGCACTGGATCTATACCTATACAAAACAAGCTACCAGCAGAGCCCACTGGGAATGGTCATG
ATATAATCAGGAATGTTATATTCACACGTTGTAGATCTGCATATGAGAGGAGGGTTTGCAGATAGCAGATTCTAG
AAAAGTTGTCTAATCAGACAGTAAATGAAGGTGTTGAAGCACTGAACAAAAATAAGCTGCTTTAATTACTCATAA
GAGGGAAGTACAAGTCATTATTCCATCTGCCAATTTACAGACTGTAAGATACCCTTTAAAAGTAGCAGTAAGTAA
ACTCTTCATAAAAGTTAGACTGTATGACAAATCCACTGCCTTTCTTCTTTTGCAGCAGGGCCTTTCTTTTTAATG
ACNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNAAGCTAGTGACTATTTTGAAAAAA
AAAGCACATTACCCTCCCTTGTTAATCACTTATGTACAAAAATGCATGTTTTGCTGTTGATCTGTTTTAACTCTT
TCTACATAAATAACACATTTGTACATGTATATGTGCAGATATATTTATAATGTTAAAATTGTGTTTAAGTGATGT
TTACTAAACAGGATAAAATTTTGTTTGGAAAATTGCGATGTGAAATTTTATCTAGTTAATCTATAGTCCTTTCCC
TTATGGTGTCCAGCTCTATGCAGGCTCTGCCTCACTCCAGATTATGTAAATATCAATTCATATTCAAATGAATTT
GAAATTTAGCT

FIGURE 489

MTNPLPFFFCSRAFLFNDXXXXXXXXXXXXXXXXXXXXXXXXXXXXXXXXXXXXXXXXXXXXXXXX
XXXXXXXXXXXXXXXXXXXXXXXXXXXXXXXXXKLVTIFEKKSTLPSLVNHLCTKMHVLLLICFNSFYINNTFV
HVYVQIYL

FIGURE 490A

GAATTCCGGCCAGAGTCACACACGGTCCTAAGAGCTGGGCACCAGGAAGCGAAGGCTGATCTGAAGAAGACACTT
GAATCATGGGTGACGTTAAAAATTTTCTGTATGCCTGGTGTGGCAAAAGGAAGATGACCCCGACCTATGAATTA
GAGCAGTGGGGAACAAAAACAGGCAGAAATTCATGTGTGAGGTTCAGGTGGAAGGTTATAATTACACTGGCATGG
GGAATTCCACCAATAAAAAAGATGCACAAAGCAATGCTGCCAGAGACTTTGTTAACTATTTGGTTCGAATAAATG
AAATAAAGAGTGAAGAAGTTCCAGCTTTTGGGGTAGCATCTCCGCCCCCACTTACTGATACTCCTGACACTACAG
CAAATGCTGAAGGAGATTTACCAACACACCATGGAGGACCTCTTCTCCACATCTTGGCTCTCAAAGCAGAAAATA
ATTCTGAGGTAGGGGCCTCTGGCTATGGTGTTCCTGGGCCCACCTGGGACCGAGGAGCCAACTTGAAGGATTACT
ACTCAAGAAAGGAAGAACAAGAAGTGCAAGCGACTCTAGAATCAGAAGAAGTGGATTTAAATGCTGGGCTTCATG
GAAACTGGACCTTGGAAAATGCTAAAGCTCGTCTAATCCAATATTTTCAGAAAGAAAAGATCCAAGGAGAATATA
AGTACACCCAAGTGGGTCCTGATCACAACAGGAGCTTTATTGCAGAAATGACCATTTATATCAAGCAGCTGGGCA
GAAGGATTTTTGCACGAGAACATGGATCAAATAAGAAATTGGCAGCACAGTCCTGTGCCCTGTCACTTGTCAGAC
AACTGTACCATCTTGGAGTGGTTGAAGCTTACACCGGACTTACAAAGAAGAAGGAAGGAGAGACAGTGGAGCCTT
ACAAAGTAAACCTCTCTCAAGATTTAGAGCATCAGCTGCAAAACATCATTCAAGAGCTAAATCTTGAGATTTTGC
CCCCGCCTGAAGATCCTTCTGTGCCAGTTGCACTCAACATTGGCAAATTGGCTCAGTTCGAACCATCTCAGCGAC
AAAACCAAGTGGGTGTGGTTCCTTGGTCACCTCCACAATCCAACTGGAATCCTTGGACTAGTAGCAACATTGATG
AGGGGCCTCTGGCTTTTGCTACTCCAGAGCAAATAAGCATGGACCTCAAGAATGAATTGATGTACCAGTTGGAAC
AGGATCATGATTTGCAAGCAATCTTGCAGGAGAGAGAGTTACTGCCTGTGAAGAAATTTGAAAGTGAGATTCTGG
AAGCAATCAGCCAAAATTCAGTTGTCATTATTAGAGGGGCTACTGGATGTGGGAAAACCACACAGGTTCCCCAGT
TCATTCTAGATGACTTTATCCAGAATGACCGAGCAGCAGAGTGTAACATCGTAGTAACTCAGCCCAGAAGAATCA
GTGCGGTTTCTGTGGCAGAGCGAGTTGCATTTGAAAGAGGAGAAGAGCCTGGAAAAAGCTGTGGATACAGCGTTC
GATTTGAGTCTGTACTTCCTCGTCCTCATGCCAGTATAATGTTTTGTACTGTAGGTGTGCTCCTGAGAAAATTAG
AAGCAGGCATTCGAGGAATCAGTCATGTAATTGTAGATGAAATACATGAAAGAGATATTAATACTAGCTTCCTTC
TGGTAGTACTGCGTGATGTTGTTCAGGCTTATCCTGAAGTTCGCATTGTTTTATGTCTGCTACTATTGATACCA
GCATGTTTTGTGAATATTTCTTCAATTGCCCATCATTGAAGTTATGGAGGACTTACCCAGTTCAAGAATATTTC
TGGAAGACTGCATTCAGATGACCCACTTTGTTCCTCCACCAAAAGACAAAAAGAAGAAGGATAAGGATGATGATG
GTGGTGAGGATGATGATGCAAATTGCAACTTGATCTGTGGTGATGAATATGGTCCAGAAACAAGGTTGAGCATGT
CTCAATTGAACGAAAAGGAAACTCCTTTTGAACTCATCGAGGCTCTACTTAAGTACATTGAAACCCTTAATGTTC
CTGGAGCTGTGTTGGTTTTTTGCCTGGCTGGAATCTGATTTATACTATGCAGAAGCATTTGGAAATGAATCCAC
ATTTTGGAAGCCATCGGTATCAGATTCTACCCCTGCATTCTCAGATTCCTCGAGAGGAACAGCGCAAAGTGTTTG
ATCCAGTACCAGTTGGAGTAACCAAGGTTATTTGTCCACAAATATTGCTGAAACAAGCATTACCATAAATGATG
TTGTTTATGTCATTGACTCCTGCAAGCAGAAAGTGAAACTCTTCACTGCTCACAACAATATGACCAACTATTCTA
CCGTATGGGCATCAAAAACAAACCTTGAGCAACGGAAAGGGCGAGCTGGCCGGAGTACGGCTGGATTCTGCTTTC
ACCTGTGCAGCCGAGCTCGTTTTGAGAGACTTGAAACCCACATGACACCAGAGATGTTCCGAACACCATTGCATG
AAATTGCTCTTAGCATAAAACTTCTGCGTCTAGGAGGAATTGGCCAATTTCTGGCCAAAGCAATTGAACCTCCCC
CTTTGGATGCTGTGATTGAAGCAGAACACACTCTTAGAGAGCTTGATGCATTAGATGCCAATGATGAGTTGACTC
CTTTGGGACGAATCCTGGCTAAACTCCCCATTGAGCCTCGTTTTGGCAAAATGATGATAATGGGGTGTATTTCT
ACGTGGGAGATGCTATCTGTACCATTGCTGCTGCTACCTGCTTTCCAGAGCCTTTCGTCAATGAAGGAAAGCAAC
TGGGCTATATCCATCGAAATTTTGCTGGAAACAGATTTTCTGATCACGTAGCCCTTTTATCAGTATTCCAAGCCT
GGGATGATGCTAGAATGGGTGGAGAAGAAGCAGAGATACGTTTTGTGAGCACAAAAGACTTAATATGGCTACAC
TAAGAATGACCTGGGAAGCCAAAGTTCAGCTCAAAGAGATTTTGATTAATTCTGGGTTTCCAGAAGATTGTTTGT
TGACACAAGTGTTTACTAACACTGGACCAGATAATAATTTGGATGTTGTTATCTCCCTCCTGGCCTTTGGTGTGT
ACCCCAATGTATGCTATCATAAGGAAAAGAGGAAGATTCTCACCACTGAAGGGCGTAATGCACTTATCCACAAAT
CATCTGTTAATTGTCCTTTTAGTAGCCAAGACATGAATTACCCATCTCCCTTCTTTGTATTTGGTGAAAAGATTC
GAACTCGAGCCATCTCTGCTAAAGGCATGACTTTAGTACCCCCCTGCAGTTGCTTCTCTTTGCCTCCAAGAAAG
TCCAATCTGATGGGCAGATTGTGCTTGTAGATGACTGGATTAAACTGCAAATATCTCATGAAGCTGCTGCCTGTA
TCACTGGTCTCCGGGCAGCCATGGAGGCTTTGGTTGTTGAAGTAACCAAACAACCTGCTATCATCAGCCAGTTGG
ACCCCGTAAATGAACGTATGCTGAACATGATCCGTCAGATCTCTGAGCCCTCAGCTGCTGGTATCAACCTTATGA
TTGGCAGTACACGGTATGGAGATGGTCCACGTCCTCCCAAGATGGCCCGATACGACAATGGAAGCGGATATAGAA

FIGURE 490B

```
GGGGAGGTTCTAGTTACAGTGGTGGAGGCTATGGCGGTGGATATAGCAGTGGAGGCTATGGTAGCGGAGGCTATG
GTGGCAGCGCAACTCCTTCGGGCAGGATATGTGCAGGTGTTGGTGGAGGCTATAGAGGAGTTTCCCGAGGTGGCT
TTAGAGGCAACTCTGGAGGAGACTACAGAGGGCCTAGTGGAGGCTACAGAGGATCTGGGGGATTCCAGCGAGGAG
GTGGTAGGGGGGCCTATGGAACTGGCTACTTGGACATTGAAGAGGAGGTGGCGGCTATAAAACTTGGTTATGTCA
GTTCTGTGTGTAGACAGTAAGGAAAAAAAGGCATGCTATGTGTTACGTGTTTTTTCCAGTATGTTTATTTGCCAC
CAAAAAGTAAATGCATTTTCACCCATTCTGTGGTTCATTGTAGTTTAAGGAAACCAAGCATATAGATGCATTAGT
GATTTTGTTTATTTTATGTAAAATATAACGATCTTCTTTTAAAAATACCACAGTTTGTATTTTTCTTTAAGGAGT
AAAGATTTGCCTTTAAATAACTTGGTATTTTCCTGGCTTTCGTTTAATACAATAGAAAATAAAGTATTACACCG
```

FIGURE 491

MGDVKNFLYAWCGKRKMTPTYEIRAVGNKNRQKFMCEVQVEGYNYTGMGNSTNKKDAQSNAARDFVNYLVRINEI
KSEEVPAFGVASPPPLTDTPDTTANAEGDLPTHHGGPLLHILALKAENNSEVGASGYGVPGPTWDRGANLKDYYS
RKEEQEVQATLESEEVDLNAGLHGNWTLENAKARLIQYFQKEKIQGEYKYTQVGPDHNRSFIAEMTIYIKQLGRR
IFAREHGSNKKLAAQSCALSLVRQLYHLGVVEAYTGLTKKKEGETVEPYKVNLSQDLEHQLQNIIQELNLEILPP
PEDPSVPVALNIGKLAQFEPSQRQNQVGVVPWSPPQSNWNPWTSSNIDEGPLAFATPEQISMDLKNELMYQLEQD
HDLQAILQERELLPVKKFESEILEAISQNSVVIIRGATGCGKTTQVPQFILDDFIQNDRAAECNIVVTQPRRISA
VSVAERVAFERGEEPGKSCGYSVRFESVLPRPHASIMFCTVGVLLRKLEAGIRGISHVIVDEIHERDINTSFLLV
VLRDVVQAYPEVRIVFMSATIDTSMFCEYFFNCPSLKLWRTYPVQEYFLEDCIQMTHFVPPPKDKKKKDKDDDGG
EDDDANCNLICGDEYGPETRLSMSQLNEKETPFELIEALLKYIETLNVPGAVLVFLPGWNLIYTMQKHLEMNPHF
GSHRYQILPLHSQIPREEQRKVFDPVPVGVTKVILSTNIAETSITINDVVYVIDSCKQKVKLFTAHNNMTNYSTV
WASKTNLEQRKGRAGRSTAGFCFHLCSRARFERLETHMTPEMFRTPLHEIALSIKLLRLGGIGQFLAKAIEPPPL
DAVIEAEHTLRELDALDANDELTPLGRILAKLPIEPRFGKMMIMGCIFYVGDAICTIAAATCFPEPFVNEGKQLG
YIHRNFAGNRFSDHVALLSVFQAWDDARMGGEEAEIRFCEHKRLNMATLRMTWEAKVQLKEILINSGFPEDCLLT
QVFTNTGPDNNLDVVISLLAFGVYPNVCYHKEKRKILTTEGRNALIHKSSVNCPFSSQDMNYPSPFFVFGEKIRT
RAISAKGMTLVPPLQLLLFASKKVQSDGQIVLVDDWIKLQISHEAAACITGLRAAMEALVVEVTKQPAIISQLDP
VNERMLNMIRQISEPSAAGINLMIGSTRYGDGPRPPKMARYDNGSGYRRGGSSYSGGGYGGGYSSGGYGSGGYGG
SATPSGRICAGVGGGYRGVSRGGFRGNSGGDYRGPSGGYRGSGGFQRGGGRGAYGTGYLDIEEEVAAIKLGYVSS
VCRQ

FIGURE 492A

```
TTTTCTTGCTTTTCTTCCCTTTTTTTTCTTTTTGCAAACAAAACAAAAAACAGCATAGAAGAAAGAGCAAAATAA
AGAAGAAGAAGAGGAGGAAGAGAGGGAAAGAGAGGAAGGGAAAAAAAACACCAACCCGGGCAGAGGAGGAGGTGC
GGCGGCGGCGGCGGCGGCAGCGGCGGCAGCGGCGCGGCGGCGGCTCGGACCCCCTCCCCCGGCTCCCCCCAT
CAGTGCAGCTCTCCGGGCGATGCCAGAATAGATGCCGGGGCAATGTCCCGCCGCAAACAGGGCAACCCGCAGCAC
TTGTCCCAGAGGGAGCTCATCACCCCAGAGGCTGACCATGTGGAGGCCGCCATCCTCGAAGAAGACGAGGGTCTG
GAGATAGAGGAGCCAAGTGGCCTGGGGCTGATGGTGGGTGGCCCCGACCCTGACCTGCTCACCTGTGGCCAGTGT
CAAATGAACTTCCCCTTGGGGGACATCCTGGTTTTTATAGAGCACAAAAGGAAGCAGTGTGGCGGCAGCTTGGGT
GCCTGCTATGACAAGGCCCTGGACAAGGACAGCCCGCCACCCTCCTCACGCTCCGAGCTCAGGAAAGTGTCCGAG
CCGGTGGAGATCGGGATCCAAGTCACCCCCGACGAAGATGACCACCTGCTCTCACCCACGAAAGGCATCTGTCCC
AAGCAGGAGAACATTGCAGGTAAAGATGAGCCTTCCAGCTACATTGCACAACATGCAAGCAGCCCTTCAACAGC
GCGTGGTTCCTGCTGCAGCACGCGCAGAACACGCACGGCTTCCGCATCTACCTGGAGCCCGGGCCGGCCAGCAGC
TCGCTCACGCCGCGGCTCACCATCCCGCCGCCGCTCGGGCCGGAGGCCGTGGCGCAGTCCCCGCTCATGAATTTC
CTGGGCGACAGCAACCCCTTCAACCTGCTGCGCATGACGGGCCCCATCCTGCGGGACCACCCGGGCTTCGGCGAG
GGCCGCCTGCCGGGCACGCCGCCTCTCTTCAGTCCCCGCCGCGCCACCACCTGGACCCGCACCGCCTCAGTGCC
GAGGAGATGGGGCTCGTCGCCCAGCACCCCAGTGCCTTCGACGAGTCATGCGCCTGAACCCCATGGCCATCGAC
TCGCCCGCCATGGACTTCTCGCGGCGGCTCCGCGAGCTGGCGGGCAACAGCTCCACGCCGCCGCCCGTGTCCCCG
GGCCGCGGCAACCCTATGCACCGGCTCCTGAACCCCTTCCAGCCCAGCCCCAAGTCCCCGTTCCTGAGCACGCCG
CCGCTGCCGCCCATGCCCCCTGGCGGCACGCCGCCCCCGCAGCCGCCAGCCAAGAGCAAGTCGTGCGAGTTCTGC
GGCAAGACCTTCAAGTTCCAGAGCAATCTCATCGTGCACCGGCGCAGTCACACGGGCGAGAAGCCCTACAAGTGC
CAGCTGTGCGACCACGCGTGCTCGCAGGCCAGCAAGCTCAAGCGCCACATGAAGACGCACATGCACAAGGCCGGC
TCGCTGGCCGGCCGCTCCGACGACGGGCTCTCGGCCGCCAGCTCCCCCGAGCCCGGCACCAGCGAGCTGGCGGGC
GAGGGCCTCAAGGCGGCCGACGGTGACTTCCGCCACCACGAGAGCGACCCGTCGCTGGGCCACGAGCCGGAGGAG
GAGGACGAGGAGGAGGAGGAGGAGGAGGAGCTGCTACTGGAGAACGAGAGCCGGCCCGAGTCGAGCTTCAGC
ATGGACTCGGAGCTGAGCCGCAACCGCGAGAACGGCGGTGGTGGGGTGCCCGGGGTCCCGGCGCGGGGGCGGC
GCGGCCAAGGCGCTGGCTGACGAGAAGGCGCTGGTGCTGGGCAAGGTCATGGAGAACGTGGGCCTAGGCGCACTG
CCGCAGTACGGCGAGCTCCTGGCCGACAAGCAGAAGCGCGGCGCCTTCCTGAAGCGTGCGGCGGGCGGCGGGGAC
GCGGGCGACGACGACGACGCGGGCGGCTGCGGGACGCGGGCGCGGGCGGCGCGGTCAACGGGCGCGGGGCGGC
TTCGCGCCAGGCACCGAGCCCTTCCCCGGGCTCTTCCCGCGCAAGCCCGCGCCGCTGCCCAGCCCCGGGCTCAAC
AGCGCCGCCAAGCGCATCAAGGTGGAGAAGGACCTGGAGCTGCCGCCCGCCGCGCTCATCCCGTCCGAGAACGTG
TACTCGCAGTGGCTGGTGGGCTACGCGGCGTCGCGGCACTTCATGAAGGACCCCTTCCTGGGCTTCACGGACGCA
CGACAGTCGCCCTTCGCCACGTCGTCCGAGCACTCGTCCGAGAACGGCAGCCTGCGCTTCTCCACGCCGCCCGGG
GACCTGCTGGACGGCGGCCTCTCGGGCCGCAGCGGCACGGCCAGCGGAGGCAGCACCCCGCACCTGGGCGGCCCG
GGCCCCGGGCGGCCCAGCTCCAAGGAGGGCCGCCGCAGCGACACGTGCGAGTACTGCGGCAAGGTGTTCAAGAAC
TGCAGCAACTTGACGGTGCACCGGCGGAGCCACACCGGCGAGCGGCCTTACAAGTGCGAGCTGTGCAACTACGCG
TGCGCGCAGAGCAGCAAGCTCACGCGCCACATGAAGACGCACGGGCAGATCGGCAAGGAGGTGTACCGCTGCGAC
ATCTGCCAGATGCCCTTCAGCGTCTACAGCACCCTGGAGAAACACATGAAAAAGTGGCACGGCGAGCACTTGCTG
ACTAACGACGTCAAAATCGAGCAGGCCGAGAGGAGCTAAGCGCGCGGGCCCCGGCGCCCCGCACCTGTACAGTGG
AACCGTTGCCAACCGAGAGAATGCTGACCTGACTTGCCTCCGTGTCACCGCCACCCCGCACCCCGCGTGTCCCCG
GGGCCCAGGGGAGGCGGCACTCCAACCTAACCTGTGTCTGCGAAGTCCTATGGAAACCCGAGGGTTGATTAAGGC
AGTACAAATTGTGGAGCCTTTTAACTGTGCAATAATTTCTGTATTTATTGGGTTTTGTAATTTTTTGGCATGTG
CAGGTACTTTTTATTATTATTTTTTCTGTTTGAATTCCTTTAAGAGATTTGTTGGGTATCCATCCCTTCTTTGT
TTTTTTTTTAACCCGGTAGTAGCCTGAGCAATGACTCGCAAGCAATGTTAGAGGGGAAGCATATCTTTTAAATTA
TAATTTGGGGGGAGGGTGGTGCTGCTTTTTGAAATTTAAGCTAAGCATGTGTAATTTCTTGTGAAGAAGCCAA
CACTCAAATGACTTTTAAAGTTGTTTACTTTTTCATTCCTTCCTTTTTTTGTCCTGAAATAAAAAGTGGCATGC
AGTTTTTTTTTTAATTATTTTTTAATTTTTTTTTGGTTTTTGTTTTGGGTGGGGGGTGTGGATGTACAGCGG
ATAACAATCTTTCAAGTCGTAGCACTTTGTTTCAGAACTGGAATGGAGATGTAGCACTCATGTCGTCCCGAGTCA
AGCGGCCTTTTCTGTGTTGATTTCGGCTTTCATATTACATAAGGGAAACCTTGAGTGGTGGTGCTGGGGGAGGCA
CCCCACAGACTCAGCGCCGCCAGAGATAGGGTTTTTGGAGGGCTCCTCTGGGAAATGGCCCGACAGCATTCTGAG
```

FIGURE 492B

```
GTTGTGCATGACCAGCAGATACTATCCTGTTGGTGTGCCCTGGGGTGCCATGGCTGCTATTCGCTGTAGATTAGG
CTACATAAAATGGGCTGAGGGTACCTTTTTGGGGAGATGGGGTGGCCTGCAGTGACACAGAAAGGAAGAAACTAG
CGGTGTTCTTTTAGGCGTTTTCTGGCTTGACGGCTTCTCTCTTTTTTAAATCACCCCCACCACATAAATCTCAA
ATCCTATGTTGCTACAAGGGGTCATCCATCATTTCCCAAGCAGACGAATGCCCTAATTAATTGAAGTTAGTGTTC
TCTCATTTAATGCACACTGATGATATTGTAGGGATGGGTGGGGTGGGGATCTTGCAAATTTCTATTCTCTTTTAC
TGAAAAAGCAGGGGATGAGTTCCATCAGAAGGTGCCCAGCGCTACTTCCCAGGTTTTTATTTTTTTTTCCTATC
TCATTAGGTTGGAAGGTACTAAATATTGAACTGTTAAGATTAGACATTTGAATTCTGTTGACCCGCACTTTAAAG
CTTTTGTTTGCATTTAAATTAAATGGCTTCTAAACAAGAAATTGCAGCATATTCTTCTCTTTGGCCCAGAGGTGG
GTTAAACTGTAAGGGACAGCTGAGATTGAGTGTCAGTATTGCTAAGCGTGGCATTCACAATACTGGCACTATAAA
GAACAAAATAAAATAATAATTTATAGGACAGTTTTTCTACTGCCATTCAATTTGATGTGAGTGCCTTGAAAACTG
ATCTTCCTATTTGAGTCTCTTGAGACAAATGCAAAACTTTTTTTTGAAATGAAAAGACTTTTTAAAAAAGTAAA
ACAAGAAAAGTACATTCTTTAGAAACTAACAAAGCCACATTTACTTTAAGTAAAAAAAAAAAAAATTCTGGTTGA
AGATAGAGGATATGAAATGCCATAAGACCCAATCAAATGAAGAAATAAACCCAGCACAACCTTGGACATCCATTA
GCTGAATTATCCTCAGCCCCTTTTGTTTTGGGACAACGCTGCTTAGATATGGAGTGGAGGTGATTTACTGCTGA
ATTAAAACTCAAGTGACACAAGTTACAAGTTGATATCGTTGAATGAAAAGCAAAACAAAAACAATTCAGGAACAA
CGGCTAATTTTTTCTAAAGTTAAATTTAGTGCACTCTGTCTTAAAAATACGTTTACAGTATTGGGTACATACAAG
GGTAAAAAAAAAATTGTGTGTATGTGTGTTGGAGCGATCTTTTTTTTTCAAAGTTTGCTTAATAGGTTATACAAA
AATGCCACAGTGGCCGCGTGTATATTGTTTCTTTTGGTGACGGGGTTTTAGTATATATTATATATATTAAAATT
TCTTGATTACTGTAAAAGTGGACCAGTATTTGTAATAATCGAGAATGCCTGGGCATTTTACAAAACAAGAAAAAA
AATACCCTTTCTTTTCCTTGAAAATGTTGCAGTAAAATTTAAATGGTGGGTCTATAAATTGTTCTTGTTACAG
TAACTGTAAAGTCGGAGTTTTAGTAAATTTTTTCTGCCTTGGGTGTTGAATTTTTATTTCAAAAAAAATGTATA
GAAACTTGTATTTGGGGATTCAAAGGGGATTGCTACACCATGTAGAAAAAGTATGTAGAAAAAAAGTGCTTAATA
TTGTTATTGCTTTGCAGAAAAAAAAAAAATCACATTTCTGACCTGTACTTATTTTTCTCTTCCCGCCTCCCTCTG
GAATGGATATATTGGTTGGTTCATATGATGTAGGCACTTGCTGTATTTTTACTGGAGCTCGTAATTTTTTAACTG
TAAGCTTGTCCTTTTAAAGGGATTTAATGTACCTTTTTGTTAGTGAATTTGGAAATAAAAAGAAAAAAAAAACAA
AAACAAACAGGCTGCCATAATATATTTTTTTAATTTGGCAGGATAAAATATTGCAAAAAAAACACATTTGTATGT
TAAGTCCTATTGTACAGGAGAAAAAGGGTTGTTTGACAACCTTTGAGAAAAAGAAACAAAAGGAAGTAGTTAAAT
GCTTTGGTTCACAAATCATTTAGTTGTATATATTTTTGTCGGAATTGGCCTACACAGAGAACCGTTCGTGTTGG
GCTTCTCTCTGAACGCCCCGAACCTTGCATCAAGGCTCCTTGGTGTGGCCACAGCAGACCAGATGGGAAATTATT
TGTGTTGAGTGGAAAAAAATCAGTTTTTGTAAAGATGTCAGTAACATTCCACATCGTCCTCCCTTTCTCTAAGAG
GCCATCTCTAAGATGTCAGATGTAGAGGAGAGAGAGCGAGAGAACATCTTCCTTCTCTACCATCACTCCTGTGGC
GGTCACCACCACCACCTCTCCCGCCCTTACCAGCAGAAAGCAATGCAAACTGAGCTGCTTTAGTCCTTGAGAAAT
TGTGAAACAAACACAAATATCATAAAAGGAGCTGGTGATTCAGCTGGGTCCAGGTGAAGTGACCTGCTGTTGAGA
CCGGTACAAATTGGATTTCAGGAAGGAGACTCCATCACAGCCAGGACCTTTCGTGCCATGGAGAGTGTTGGCCTC
TTGTCTTTCTTCCCTGCTTTGCTGCTTTGCTCTCTGAAACCTACATTCCGTCAGTTTCCGAATGCGAGGGCCTGG
GATGAATTTGGTGCCTTTCCATATCTCGTTCTCTCTCCTTCCCCTGCGTTTCCTCTCCATCCTTCATCCTCCATT
GGTCCTTTTTTTTCTTTCATTTTTATTTAATTTCTTTTCTTCCTGTCTGTTCCTCCCCTAATCCTCTATTTTA
TTTTATTTTTTGTAAAGCCAAGTAGCTTTAAGATAAAGTGGTGGTCTTTTGGATGAGGGAATAATGCATTTTA
AATAAAATACCAATATCAGGAAGCCATTTTTTATTTCAGGAAATGTAAGAAACCATTATTTCAGGTTATGAAAGT
ATAACCAAGCATCCTTTTGGGCAATTCCTTACCAAATGCAGAAGCTTTCTGTTCGATGCACTCTTTCCTCCTTG
CCACTTACCTTTGCAAAGTTAAAAAAAGGGGGAGGGAATGGGAGAGAAAGCTGAGATTTCAGTTTCCTACTGC
AGTTTCCTACCTGCAGATCCAGGGGCTGCTGTTGCCTTTGGATGCCCCACTGAGGTCCTAGAGTGCCTCCAGGGT
GGTCTTCCTGTAGTCATAACAGCTAGCCAGTGCTCACCAGCTTACCAGATTGCCAGGACTAAGCCATCCCAAAGC
ACAAGCATTGTGTGTCTCTGTGACTGCAGAGAAGAGAGAATTTTGCTTCTGTTTTGTGTTTAAAAAAACCAACACG
GAAGCAGATGATCCCGAGAGAGAGGCCTCTAGCATGGGTGACCCAGCCGACCTCAGGCCGGTTTCCGCACTGCCA
CAACTTTGTTCAAAGTTGCCCCCAATTGGAACCTGCCACTTGGCATTAGAGGGTCTTTCATGGGGAGAGAAGGAG
ACTGAATTACTCTAAGCAAAATGTGAAAAGTAAGGAAATCAGCCTTTCATCCCGGTCCTAAGTAACCGTCAGCCG
AAGGTCTCGTGGAACACAGGCAAACCCGTGATTTTGGTGCTCCTTGTAACTCAGCCCTGCAAAGCAAAGTCCCAT
```

FIGURE 492C

```
TGATTTAAGTTGTTTGCATTTGTACTGGCAAGGCAAAATATTTTTATTACCTTTTCTATTACTTATTGTATGAGC
TTTGTTGTTTACTTGGAGGTTTTGTCTTTTACTACAAGTTTGGAACTATTTATTATTGCTTGGTATTTGTGCTC
TGTTTAAGAAACAGGCACTTTTTTTTATTATGGATAAAATGTTGAGATGACAGGAGGTCATTTCAATATGGCTTA
GTAAAATATTTATTGTTCCTTTATTCTCTGTACAAGATTTGGGCCTCTTTTTTTCCTTAATGTCACAATGTTGA
GTTCAGCATGTGTCTGCCATTTCATTTGTACGCTTGTTCAAAACCAAGTTGTTCTGGTTTCAAGTTATAAAAAT
AAATTGGACATTTAACTTGATCTCCAAA
```

FIGURE 493

MSRRKQGNPQHLSQRELITPEADHVEAAILEEDEGLEIEEPSGLGLMVGGPDPDLLTCGQCQMNFPLGDILVFIE
HKRKQCGGSLGACYDKALDKDSPPPSSRSELRKVSEPVEIGIQVTPDEDDHLLSPTKGICPKQENIAGKDEPSSY
ICTTCKQPFNSAWFLLQHAQNTHGFRIYLEPGPASSSLTPRLTIPPPLGPEAVAQSPLMNFLGDSNPFNLLRMTG
PILRDHPGFGEGRLPGTPPLFSPPPRHHLDPHRLSAEEMGLVAQHPSAFDRVMRLNPMAIDSPAMDFSRRLRELA
GNSSTPPPVSPGRGNPMHRLLNPFQPSPKSPFLSTPPLPPMPPGGTPPPQPPAKSKSCEFCGKTFKFQSNLIVHR
RSHTGEKPYKCQLCDHACSQASKLKRHMKTHMHKAGSLAGRSDDGLSAASSPEPGTSELAGEGLKAADGDFRHHE
SDPSLGHEPEEEDEEEEEEEELLLENESRPESSFSMDSELSRNRENGGGGVPGVPGAGGGAAKALADEKALVLG
KVMENVGLGALPQYGELLADKQKRGAFLKRAAGGGDAGDDDDAGGCGDAGAGGAVNGRGGGFAPGTEPFPGLFPR
KPAPLPSPGLNSAAKRIKVEKDLELPPAALIPSENVYSQWLVGYAASRHFMKDPFLGFTDARQSPFATSSEHSSE
NGSLRFSTPPGDLLDGGLSGRSGTASGGSTPHLGGPGPGRPSSKEGRRSDTCEYCGKVFKNCSNLTVHRRSHTGE
RPYKCELCNYACAQSSKLTRHMKTHGQIGKEVYRCDICQMPFSVYSTLEKHMKKWHGEHLLTNDVKIEQAERS

FIGURE 494

```
GTAGATGTCTAGTTATTCCTCATGTAAAACACAACATTTCAACCCTGAGTACTATAAACTTTATTATGCTTCTAG
GTTACTTTTCTCTTTAAGCAATTATTCCTACATTCCTAAGTGTTCACCAGTGGAACAGATAAGAGATAGAAGTA
GTTAGAAATTGAGATAATTGGGTTGACCTGTCATTGTTGCCAGGATAATTACTGGAAGATTAAGCCTATCTGTTA
GACATTTTGACCATGTTTATAATTGTTGTTAGTATTCTGTCAGAATGTATCTGTTTCTAGTTATTAAAAGAAGC
AACAGAATCGAGGCACAAATATGAAGAAATGAAACAAGAAGAAGCACAACTGAAAGAGCAGCTTTTCCTTTATAT
GGATAAGTTTGAAGAATTCCAGACTACCATGGCAAAAACCAATGAACTTTTTACAGCCTTCAAGCAGGAAACGGA
AAAGCTGACAAAGAAAATTAAAAAACTGGAAAAAGAAATGGTAATATGGTATACCAAATGGGAAAATAATAATAC
AACACTTCTGCAAATGGCTGAAGAGAAAACTATTCGTGATAAAAATTATAAGGTCTTTCAAATAAAATTGGAGCG
GTTAGAGAAGCTGTACAAGGCTCTTCAAATAGAAAGGAATGAACTCAGTGAGAAACTGGGAATTCTGAAAGGGCA
GGTCTCTGTGAAAGTAGCAGATGTAGATTTAGCAGTGCCTGTGACGCATTCCTGTGCTGACCTGGATTCTTCCAA
TATGCTGAACACTTCCTCTAAAAGAGCCCCAGGAGTCCATCTGGAGGCTGACCCCAAAGGAATGAATGAAGTAAA
ATGCTACTCAAAAGCCCTCTCCACAGGATCTCCTCTAGGCATTGATTAAGATTAAGTGTGATCATTGTACTGATG
GATATATTTGTGTACATGTTTCTCTTTAGTTGTAACTATTGATTTGTAATGAAAATTTCCTCTCCTTTTTCT
ACCATATCTCTGTTTTTTAGAACTACTCAACTGTGTGGTAACAGAAAGCTTCTTACCAATTTCCCCAACTATGT
TGCACATCAGCCTCATTTTCCCCCTTTATTGGAATGCATGTTTTCATTGCCTTCTCCTTTCAAAGTGTACGTTTG
TGTGTTCATCACCTTAAATTATCTTAATTTGAGACTTTTTATAATGGTTTCGTAATGTGAAATCAAATACTAAT
TTAAACTCTGGAGCCCATAATATCTACATAAAAGAAAATATAAACTGACTAATATTGTCAAGTCATTTAAATGAT
AAGTAAAACTTCAATGGATTAAGAAACAAGCATGGCATATTTGATTCAGATCAGTTTTTGACAATATTTGTATG
ACTTTCCAAATTGATGTGACTGTAAACTTTGAATTCCTCAAAATTGACAGAATATATATATATATATATATAT
ATATATATATATATATATGTATGTACACACACAGAGAGATCATTTAAATGTAAATGATGTTAAGAAAAACC
AAAACAGTAGCATATGCAGGCAAGTCATTGGACCAATAGGCTTAATATTTATGAAACTGACAATTGTTCTGCTTT
AGTTTCAGGTTACAATTATGTTTAAAGAAAAAAAAATCAGTATCTAGATCTCTGCACTTGGCATGGAAAATTTTG
AACTATTTATTCCTTAATTTTCTTTTATTTCAGTTTCTCATAGAGCTAAATGGTTTTACATATATTCTCTTGTCA
GATTTGTGGTCTAATAGAGGTAGAAAATGGAAATTTTCCCAGTACTTAGAAATATGGTACTTAGGAAGAAGTCTA
GGATGTGAATTACATATACACTTCCCCTAGTGACTATGATAATCAAGGGGGCAGATAGCAGAGGAAAATAAGTTA
ACATGAAATTTGACAAATTTTATTACTTTGCCAAAATTAGCAAAACAAAATACTCACCTTCCCCTGCTCACCCC
CCAACTTTTTATAAATATTCAATTCAGCTACAAAACAAAATACTGGACCCACTTCTTTCAGAAGAGATGAAGATA
CCTTATATGCCCTAAAGTTAATACCAGCAGTCATATTTATCAGATGTAAATCTGGATGTAAGCTCTTAATGTTA
TACTAAGGCAGTTCTTAGGCTGTGACACTTCTTTGTGGTACTTGTTTTGTGTGAAAGGTAAATTTTGGGGAGAA
AACAATGTGAAAAACAGAACTTGTTCTGTTGTTTTTGGCATACTGTTTATGTTAGATACACTGTGTTACAATACA
ATATTACGAAGATCTGCATTGTATTTTGGAATTTGGTTTCCTTTCAGAATTATTGCTCTGGCTAGCATTGGAAAC
AACAACAACAACAAAACCCAAAGGAACCCTTTGCAGAAGATTCCCTTGTAAATGGCCCTGTGGCATGCCCAGTAT
CTGCAATGTTCTAGAATAGAAGTTGGCAAACCTCTCTGTTTGCCAAGCCTGCAGAGTTGAACATGTCCATAAATG
TATACAATCTGACCCTGTTTTTTGGCCCTGTTTCTGGACACTGTAGCTGACCAAGAAAATGTTTAAATGTTGCGA
TCAATTAAATTTTTTTGTTGTA
```

FIGURE 495

MKQEEAQLKEQLFLYMDKFEEFQTTMAKTNELFTAFKQETEKLTKKIKKLEKEMVIWYTKWENNNTTLLQMAEEK
TIRDKNYKVFQIKLERLEKLYKALQIERNELSEKLGILKGQVSVKVADVDLAVPVTHSCADLDSSNMLNTSSKRA
PGVHLEADPKGMNEVKCYSKALSTGSPLGID

FIGURE 496A

```
AGATTTGATAATGGGCTGCATTAAAAGTAAAGAAAACAAAAGTCCAGCCATTAAATACAGACCTGAAAATACTCC
AGAGCCTGTCAGTACAAGTGTGAGCCATTATGGAGCAGAACCCACTACAGTGTCACCATGTCCGTCATCTTCAGC
AAAGGGAACAGCAGTTAATTTCAGCAGTCTTTCCATGACACCATTTGGAGGATCCTCAGGGGTAACGCCTTTTGG
AGGTGCATCTTCCTCATTTTCAGTGGTGCCAAGTTCATATCCTGCTGGTTTAACAGGTGGTGTTACTATATTTGT
GGCCTTATATGATTATGAAGCTAGAACTACAGAAGACCTTTCATTTAAGAAGGGTGAAAGATTTCAAATAATTAA
CAATACGGAAGGAGATTGGTGGGAAGCAAGATCAATCGCTACAGGAAAGAATGGTTATATCCCGAGCAATTATGT
AGCGCCTGCAGATTCCATTCAGGCAGAAGAATGGTATTTTGGCAAAATGGGGAGAAAAGATGCTGAAAGATTACT
TTTGAATCCTGGAAATCAACGAGGTATTTTCTTAGTAAGAGAGAGTGAAACAACTAAAGGTGCTTATTCCCTTTC
TATTCGTGATTGGGATGAGATAAGGGGTGACAATGTGAAACACTACAAAATTAGGAAACTTGACAATGGTGGATA
CTATATCACAACCAGAGCACAATTTGATACTCTGCAGAAATTGGTGAAACACTACACAGAACATGCTGATGGTTT
ATGCCACAAGTTGACAACTGTGTGTCCAACTGTGAAACCTCAGACTCAAGGTCTAGCAAAAGATGCTTGGGAAAT
CCCTCGAGAATCTTTGCGACTAGAGGTTAAACTAGGACAAGGATGTTTCGGCGAAGTGTGGATGGGAACATGGAA
TGGAACCACGAAAGTAGCAATCAAAACACTAAAACCAGGTACAATGATGCCAGAAGCTTTCCTTCAAGAAGCTCA
GATAATGAAAAAATTAAGACATGATAAACTTGTTCCACTATATGCTGTTGTTTCTGAAGAACCAATTTACATTGT
CACTGAATTTATGTCAAAAGGAAGCTTATTAGATTTCCTTAAGGAAGGAGATGGAAAGTATTTGAAGCTTCCACA
GCTGGTTGATATGGCTGCTCAGATTGCTGATGGTATGGCATATATTGAAAGAATGAACTATATTCACCGAGATCT
TCGGGCTGCTAATATTCTTGTAGGAGAAAATCTTGTGTGCAAAATAGCAGACTTTGGTTTAGCAAGGTTAATTGA
AGACAATGAATACACAGCAAGACAAGGTGCAAAATTTCCAATCAAATGGACAGCTCCTGAAGCTGCACTGTATGG
TCGGTTTACAATAAAGTCTGATGTCTGGTCATTTGGAATTCTGCAAACAGAACTAGTAACAAAGGGCCGAGTGCC
ATATCCAGGTATGGTGAACCGTGAAGTACTAGAACAAGTGGAGCGAGGATACAGGATGCCGTGCCCTCAGGGCTG
TCCAGAATCCCTCCATGAATTGATGAATCTGTGTTGGAAGAAGGACCCTGATGAAGACCAACATTTGAATATAT
TCAGTCCTTCTTGGAAGACTACTTCACTGCTACAGAGCCACAGTACCAGCCAGGAGAAAATTTATAATTCAAGTA
GCCTATTTTATATGCACAAATCTGCCAAAATATAAAGAACTTGTGTAGATTTTCTACAGGAATCAAAAGAAGAAA
ATCTTCTTTACTCTGCATGTTTTAATGGTAAACTGGAATCCCAGATATGGTTGCACAAAACCACTTTTTTTTCC
CCAAGTATTAAACTCTAATGTACCAATGATGAATTTATCAGCGTATTTCAGGGTCCAAACAAAATAGAGCTAAGA
TACTGATGACAGTGTGGGTGACAGCATGGTAATGAAGGACAGTGAGGCTCCTGCTTATTTATAAATCATTTCCTT
TCTTTTTTTCCCCAAAGTCAGAATTGCTCAAAGAAAATTATTTATTGTTACAGATAAAACTTGAGAGATAAAAAG
CTATACCATAATAAAATCTAAAATTAAGGAATATCATGGGACCAAATAATTCCATTCCAGTTTTTTAAAGTTTCT
TGCATTTATTATTCTCAAAAGTTTTTTCTAAGTTAAACAGTCAGTATGCAATCTTAATATATGCTTTCTTTTGCA
TGGACATGGGCCAGGTTTTTCAAAAGGAATATAAACAGGATCTCAAACTTGATTAAATGTTAGACCACAGAAGTG
GAATTTGAAAGTATAATGCAGTACATTAATATTCATGTTCATGGAACTGAAAGAATAAGAACTTTTTCACTTCAG
TCCTTTTCTGAAGAGTTTGACTTAGAATAATGAAGGTAACTAGAAAGTGAGTTAATCTTGTATGAGGTTGCATTG
ATTTTTTAAGGCAATATATAATTGAAACTACTGTCCAATCAAAGGGGAAATGTTTTGATCTTTAGATAGCATGCA
AAGTAAGACCCAGCATTTTAAAAGCCCTTTTTAAAAACTAGACTTCGTACTGTGAGTATTGCTTATATGTCCTTA
TGGGGATGGGTGCCACAAATAGAAAATATGACCAGATCAGGGACTTGAATGCACTTTGCTCATGGTGAATATAG
ATGAACAGAGAGGAAAATGTATTTAAAAGAAATACGAGAAAAGAAAATGTGAAAGTTTTACAAGTTAGAGGGATG
GAAGGTAATGTTTAATGTTGATGTCATGGAGTGACAGAATGGCTTTGCTGGCACTCAGAGCTCCTCACTTAGCTA
TATTCTGAGACTTTGAAGAGTTATAAAGTATAACTATAAAACTAATTTTCTTACACACTAAATGGGTATTTGTT
CAAAATAATGAAGTTATGGCTTCACATTCATTGCAGTGGGATATGGTTTTTATGTAAAACATTTTTAGAACTCCA
GTTTTCAAATCATGTTTGAATCTACATTCACTTTTTTTGTTTCTTTTTGAGACGGAGTCTCGCTCTGCCGCC
CAGGCTGGAGTGCAGTGGCGCGATCTCGGCTCACTGCAAGCTCTGCCTCCCAGGTTCACACCATTCTCCTGCCTC
AGCCTCCCGAGTAGCTGGGACTACAGGTGCCCACCACCACGCCTGGCTAGTTTTTGTATTTTAGTAGAGACGC
AGTTTCACCGTGTTAGCCAGGATGGTCTCGATCTCCTGACCTTGTGATCTGCCCGCCTCGGCCTCCCAAAGTGCT
GGGATTACAGGCGTGAGCCACCGCGCCCAGCCTACATTCACTTCTAAAGTCTATGTAATGGTGGTCATTTTTCC
CTTTTAGAATACATTAAATGGTTGATTTGGGGAGGAAAACTTATTCTGAATATTAACGGTGGTGAAAAGGGGACA
GTTTTTACCCTAAAGTGCAAAAGTGAAACATACAAAATAAGACTAATTTTAAGAGTAACTCAGTAATTTCAAAA
TACAGATTTGAATAGCAGCATTAGTGGTTTGAGTGTCTAGCAAAGGAAAAATTGATGAATAAAATGAAGGTCTGG
TGTATATGTTTTAAAATACTCTCATATAGTCACACTTTAAATTAAGCCTTATATTAGGCCCCTCTATTTTCAGGA
```

FIGURE 496B

```
TATAATTCTTAACTATCATTATTTACCTGATTTTAATCATCAGATTCGAAATTCTGTGCCATGGCGTATATGTTC
AAATTCAAACCATTTTTAAAATGTGAAGATGGACTTCATGCAAGTTGGCAGTGGTTCTGGTACTAAAAATTGTGG
TTGTTTTTTCTGTTTACGTAACCTGCTTAGTATTGACACTCTCTACCAAGAGGGTCTTCCTAAGAAGAGTGCTGT
CATTATTTCCTCTTATCAACAACTTGTGACATGAGATTTTTTAAGGGCTTTATGTGAACTATGATATTGTAATTT
TTCTAAGCATATTCAAAAGGGTGACAAAATTACGTTTATGTACTAAATCTAATCAGGAAAGTAAGGCAGGAAAAG
TTGATGGTATTCATTAGGTTTTAACTGAATGGAGCAGTTCCTTATATAATAACAATTGTATAGTAGGGATAAAAC
ACTAACTTAATGTGTATTCATTTTAAATTGTTCTGTATTTTAAATTGCCAAGAAAAACAACTTTGTAAATTTGG
AGATATTTTCCAACAGCTTTTCGTCTTCAGTGTCTTAATGTGGAAGTTAACCCTTACCAAAAAAGGAAGTTGGCA
AAAACAGCCTTCTAGCACACTTTTTTAAATGAATAATGGTAGCCTAAACTTAATATTTTTATAAAGTATTGTAAT
ATTGTTTGTGGATAATTGAAATAAAAAGTTCTCATTGAATGCACCTATTAAAAAAAAAAAAAAAAAA
```

FIGURE 497

MGCIKSKENKSPAIKYRPENTPEPVSTSVSHYGAEPTTVSPCPSSSAKGTAVNFSSLSMTPFGGSSGVTPFGGAS
SSFSVVPSSYPAGLTGGVTIFVALYDYEARTTEDLSFKKGERFQIINNTEGDWWEARSIATGKNGYIPSNYVAPA
DSIQAEEWYFGKMGRKDAERLLLNPGNQRGIFLVRESETTKGAYSLSIRDWDEIRGDNVKHYKIRKLDNGGYYIT
TRAQFDTLQKLVKHYTEHADGLCHKLTTVCPTVKPQTQGLAKDAWEIPRESLRLEVKLGQGCFGEVWMGTWNGTT
KVAIKTLKPGTMMPEAFLQEAQIMKKLRHDKLVPLYAVVSEEPIYIVTEFMSKGSLLDFLKEGDGKYLKLPQLVD
MAAQIADGMAYIERMNYIHRDLRAANILVGENLVCKIADFGLARLIEDNEYTARQGAKFPIKWTAPEAALYGRFT
IKSDVWSFGILQTELVTKGRVPYPGMVNREVLEQVERGYRMPCPQGCPESLHELMNLCWKKDPDERPTFEYIQSF
LEDYFTATEPQYQPGENL

FIGURE 498

GGGGGAGTGCGAATTTCTTGGCCTGTCGGCAGGTGCTTTCTCAAAGGCCCCACAGTCCTCCACTTCCTGGGGAGG
TAGCTGCAGAATAAAACCAGCAGAGACTCCTTTTCTCCTAACCGTCCCGGCCACCGCTGCCTCAGCCTCTGCCTC
CCAGCCTCTTTCTGAGGGAAAGGACAAGATGAAGTGGAAGGCGCTTTTCACCGCGGCCATCCTGCAGGCACAGTT
GCCGATTACAGAGGCACAGAGCTTTGGCCTGCTGGATCCCAAACTCTGCTACCTGCTGGATGGAATCCTCTTCAT
CTATGGTGTCATTCTCACTGCCTTGTTCCTGAGAGTGAAGTTCAGCAGGAGCGCAGACGCCCCCGCGTACCAGCA
GGGCCAGAACCAGCTCTATAACGAGCTCAATCTAGGACGAAGAGAGGAGTACGATGTTTTGGACAAGAGACGTGG
CCGGGACCCTGAGATGGGGGGAAAGCCGAGAAGGAAGAACCCTCAGGAAGGCCTGTACAATGAACTGCAGAAAGA
TAAGATGGCGGAGGCCTACAGTGAGATTGGGATGAAAGGCGAGCGCCGGAGGGGCAAGGGGCACGATGGCCTTTA
CCAGGGTCTCAGTACAGCCACCAAGGACACCTACGACGCCCTTCACATGCAGGCCCTGCCCCCTCGCTAACAGCC
AGGGGATTTCACCACTCAAAGGCCAGACCTGCAGACGCCCAGATTATGAGACACAGGATGAAGCATTTACAACCC
GGTTCACTCTTCTCAGCCACTGAAGTATTCCCCTTTATGTACAGGATGCTTTGGTTATATTTAGCTCCAAACCTT
CACACACAGACTGTTGTCCCTGCACTCTTTAAGGGAGTGTACTCCCAGGGCTTACGGCCCTGCCTTGGGCCCTCT
GGTTTGCCGGTGGTGCAGGTAGACCTGTCTCCTGGCGGTTCCTCGTTCTCCCTGGGAGGCGGGCGCACTGCCTCT
CACAGCTGAGTTGTTGAGTCTGTTTTGTAAAGTCCCCAGAGAAAGCGCAGATGCTAGCACATGCCCTAATGTCTG
TATCACTCTGTGTCTGAGTGGCTTCACTCCTGCTGTAAATTTGGCTTCTGTTGTCACCTTCACCTCCTTTCAAGG
TAACTGTACTGGGCCATGTTGTGCCTCCCTGGTGAGAGGGCCGGGCAGAGGGGCAGATGGAAAGGAGCCTAGGCC
AGGTGCAACCAGGGAGCTGCAGGGGCATGGGAAGGTGGGCGGGCAGGGGAGGGTCAGCCAGGGCCTGCGAGGGCA
GCGGGAGCCTCCCTGCCTCAGGCCTCTGTGCCGCACCATTGAACTGTACCATGTGCTACAGGGGCCAGAAGATGA
ACAGACTGACCTTGATGAGCTGTGCACAAAGTGGCATAAAAAACAGTGTGGTTACACAGTGTGAATAAAGTGCTG
CGGAGCAAGAGGAGGCCGTTGATTCACTTCACGCTTTCAGCGAATGACAAAATCATCTTTGTGAAGGCCTCGCAG
GAAGACGCAACACATGGGACCTATAACTGCCCAGCGGACAGTGGCAGGACAGGAAAAACCCGTCAATGTACTAGG
GTACTGCTGCGTCATTACAGGGCACAGGCCATGGATGGAAAACGCTCTCTGCTCTGCTTTTTTTCTACTGTTTTA
ATTTATACTGGCATGCTATTGCCTTCCTATTTTGCATAATAAATGCTTCAGTGAAAATGCAGCTTTACTCTAA

FIGURE 499

MKWKALFTAAILQAQLPITEAQSFGLLDPKLCYLLDGILFIYGVILTALFLRVKFSRSADAPAYQQGQNQLYNEL
NLGRREEYDVLDKRRGRDPEMGGKPRRKNPQEGLYNELQKDKMAEAYSEIGMKGERRRGKGHDGLYQGLSTATKD
TYDALHMQALPPR

FIGURE 500

AGCGATTTCATCTTCAGGCCTGGACTACACCACTCACCCTCCCAGTGTGCTTGAGAAACAAACTGCACCCACTGA
ACTCCGCAGCTAGCATCCAAATCAGCCCTTGAGATTTGAGGCCTTGGAGACTCAGGAGTTTTGAGAGCAAAATGA
CAACACCCAGAAATTCAGTAAATGGGACTTTCCCGGCAGAGCCAATGAAAGGCCCTATTGCTATGCAATCTGGTC
CAAAACCACTCTTCAGGAGGATGTCTTCACTGGTGGGCCCCACGCAAAGCTTCTTCATGAGGGAATCTAAGACTT
TGGGGGCTGTCCAGATTATGAATGGGCTCTTCCACATTGCCCTGGGGGGTCTTCTGATGATCCCAGCAGGGATCT
ATGCACCCATCTGTGTGACTGTGTGGTACCCTCTCTGGGGAGGCATTATGTATATTATTTCCGGATCACTCCTGG
CAGCAACGGAGAAAAACTCCAGGAAGTGTTTGGTCAAAGGAAAAATGATAATGAATTCATTGAGCCTCTTTGCTG
CCATTTCTGGAATGATTCTTTCAATCATGGACATACTTAATATTAAAATTTCCCATTTTTTAAAAATGGAGAGTC
TGAATTTTATTAGAGCTCACACACCATATATTAACATATACAACTGTGAACCAGCTAATCCCTCTGAGAAAAACT
CCCCATCTACCCAATACTGTTACAGCATACAATCTCTGTTCTTGGGCATTTTGTCAGTGATGCTGATCTTTGCCT
TCTTCCAGGAACTTGTAATAGCTGGCATCGTTGAGAATGAATGGAAAAGAACGTGCTCCAGACCCAAATCTAACA
TAGTTCTCCTGTCAGCAGAAGAAAAAAAAGAACAGACTATTGAAATAAAAGAAGAAGTGGTTGGGCTAACTGAAA
CATCTTCCCAACCAAAGAATGAAGAAGACATTGAAATTATTCCAATCCAAGAAGAGGAAGAAGAAGAAACAGAGA
CGAACTTTCCAGAACCTCCCCAAGATCAGGAATCCTCACCAATAGAAAATGACAGCTCTCCTTAAGTGATTTCTT
CTGTTTTCTGTTTCCTTTTTTAAACATTAGTGTTCATAGCTTCCAAGAGACATGCTGACTTTCATTTCTTGAGGT
ACTCTGCACATACGCACCACATCTCTATCTGGCCTTTGCATGGAGTGACCATAGCTCCTTCTCTCTTACATTGAA
TGTAGAGAATGTAGCCATTGTAGCAGCTTGTGTTGTCACGCTTCTTCTTTTGAGCAACTTTCTTACACTGAAGAA
AGGCAGAATGAGTGCTTCAGAATGTGATTTCCTACTAACCTGTTCCTTGGATAGGCTTTTAGTATAGTATTTTT
TTTTGTCATTTTCTCCATCAACAACCAGGGAGACTGCACCTGATGGAAAAGATATATGACTGCTTCATGACATTC
CTAAACTATCTTTTTTTTATTCCACATCTACGTTTTGGTGGAGTCCCTTTTGCATCATTGTTTTAAGGATGATA
AAAAAAAAATAACAACTAGGGACAATACAGAACCCATTCCATTTATCTTTCTACAGGGCTGACATTGTGGCACAT
TCTTAGAGTTACCACACCCCATGAGGGAAGCTCTAAATAGCCAACACCCATCTGTTTTTGTAAAAACAGCATAG
CTT

FIGURE 501

MTTPRNSVNGTFPAEPMKGPIAMQSGPKPLFRRMSSLVGPTQSFFMRESKTLGAVQIMNGLFHIALGGLLMIPAG
IYAPICVTVWYPLWGGIMYIISGSLLAATEKNSRKCLVKGKMIMNSLSLFAAISGMILSIMDILNIKISHFLKME
SLNFIRAHTPYINIYNCEPANPSEKNSPSTQYCYSIQSLFLGILSVMLIFAFFQELVIAGIVENEWKRTCSRPKS
NIVLLSAEEKKEQTIEIKEEVVGLTETSSQPKNEEDIEIIPIQEEEEEETETNFPEPPQDQESSPIENDSSP

FIGURE 502

```
AGGCGCTGCGGAGACGCGTAGAGGAGCGCGCCCCCCGGCCGMTGCCGMCCCTGGCCCGTGCCGTCACCCCGCTTC
TCCGCGCCTCGGGCGGTACCCAGCCAGTCCCCAGCGCCGCGCTACCGCGCTGACCGGCCCTCCAGACGCCTCCCG
GTACCCGGGACCCCAGCCCGGCCGCTCGCCCGCAGCCCGCCGGCCGCACACGTCCCCGGAGCCGGGCCTAGGGCG
GGCGGCAGGGCGGCTCGGCGCAGTCAGGCTGGGCTCTGTAGCGTCCCCATGGCCGCGGCCGGCTGGCGGGACGGC
TCCGGCCAGGAGAAGTACCGGCTCGTGGTGGTCGGCGGGGCGGCGTGGGCAAGTCGGCGCTCACCATCCAGTTC
ATCCAGTCCTATTTTGTAACGGATTATGATCCAACCATTGAAGATTCTTACACAAAGCAGTGTGTGATAGATGAC
AGAGCAGCCCGGCTAGATATTTTGGATACAGCAGGACAAGAAGAGTTTGGAGCCATGAGAGAACAGTATATGAGG
ACTGGCGAAGGCTTCCTGTTGGTCTTTTCAGTCACAGATAGAGGCAGTTTTGAAGAAATCTATAAGTTTCAAAGA
CAGATTCTCAGAGTAAAGGATCGTGATGAGTTCCCAATGATTTTAATTGGTAATAAAGCAGATCTGGATCATCAA
AGACAGGTAACACAGGAAGAAGGACAACAGTTAGCACGGCAGCTTAAGGTAACATACATGGAGGCATCAGCAAAG
ATTAGGATGAATGTAGATCAAGCTTTCCATGAACTTGTCCGGGTTATCAGGAAATTTCAAGAGCAGGAATGTCCT
CCTTCACCAGAACCAACACGGAAAGAAAAAGACAAGAAAGGCTGCCATTGTGTCATTTCTAGAATCCCTTCAGT
TTTAGCTACCAACGGCCAGGAAAAGCCCTCATCTTCTCTTTCTCTCCTCAGTTACATCTTGTTGGTACCTTTCT
AGCCTTAGACAAATGATCACCATGTTAGCCTTAGACGAAGAAGCTGGCTAGTCCTTTCTGTGAAGCTAATACAAT
GGTCATTTCCAGACAAATTTAAAGGAAACACTAAGGCTGCTTCAAAGATTATCTGATTCCTTTAAAATATATGTC
TATATACACAGACATGCTCTTTTTTAAGTGCTTACATTTTAATAGAGATGAATCAGTTTTGGAATCTAAGCTGT
TTGCCAAGCTGAAGCTACAGGTTGTGAAATAATTTTTAACTTTTGGAATCATACTGCCTACTGTTACTCTAAATA
GAAATATAGGGTTTTTTTTAATGTGAATTTTTGCCTATCTTTAAACATTTCAATGTCAGCCTTTGTTAACCTTAA
ATACACTGAATTGAATCTACAAAAGTGAACCATCTCAGACCTTTACTGATACTACAACTTTTGTTTTCTGATGGC
CAAAATACCAAATGCCTGTTGTATTTATGGATTAAAAACTGCTTATAAAACCCTGTGTTACTACTCCTACTCTTG
GAGATGATAATATTCTATGTGGTCAAATATTTGGACTCATTTAGGACTTAGATATTTCAGTGTACTTGATTTTTT
AATTTAACTCTTTTTCACAGCCACGCTAAGGGTAAAAGGAATAATTTCCTTCTGTCTTCCTTTTCAAGTATTTC
TGGGTAAGGGATTCAAAAAACTAAAACTGTTTTTGTTTGTAATATAAAATATGGAATTGATCTTTCCAGGGTCAG
AGATGATTAATGTTTTTGCTATATACTTTTATACATTATTTTCTTATCAAACTAGTTAACAAGTATTTTTATATG
TTTGTAAGCAGATATGCTTTCATAGCATACCTTGTGTATATGTAAAGATAAGTATTTAATTCTCACTGTTCACTT
TTAACTGACAAAGAAAAACAAGTGGAAACTACAGAAACTGTGGTAGAACTTTTACTTGCTGGTCTGGTCTTGGTT
GTACCCATCTTTGGCCAGTCACATAACTACTCAAGAAACCTTCCCAATAGAGTACAACAGGATGAGACTCTGAAA
TCACTTTCAGTATTCCCTGCTAGATATTGATTGTTATTTCAAGTATTAAGTGTAAGCTTTTAATGGATAATTAGT
ATAACTGTGGATGGCATCTGATTTGTTTTTAATTCTGTGGATTGTGTTTAAGCAATTCAATAGTATGTTCCTGA
TTTTGAGATGCTAAGTGGTATTGCACAGTTGTCACTTTATCAAGTGTGTACAACAGTCCCATGAAGTTTATAGAG
CATACCCTTGTATAGCTTCAGGTGCTAGAATTAAAATTGATCTGTTATCACAAAAAAAAAAAAAAAAAAAAAAGG
CTCTTTAATTAGGCG
```

FIGURE 503

```
TTTCAGGCCAACATGGCCGTGCTGCTGCTGCTGCTCCGTGCCCTCCGCCGGGGTCCAGGCCCGGGTCCTCGGCCG
CTGTGGGGCCCAGGCCCGGCCTGGAGTCCAGGGTTCCCCGCCAGGCCCGGGAGGGGGCGGCCGTACATGGCCAGC
AGGCCTCCGGGGGACCTCGCCGAGGCTGGAGGCCGAGCTCTGCAGAGCTTACAATTGAGACTGCTAACCCCTACC
TTTGAAGGGATCAACGGATTGTTGTTGAAACAACATTTAGTTCAGAATCCAGTCAGACTCTGGCAACTTTTAGGT
GGTACTTTCTATTTTAACACCTCAAGGTTGAAGCAGAAGAATAAGGAGAAGGATAAGTCGAAGGGGAAGGCGCCT
GAAGAGGACGAAGAGGAGAGGAGACGCCGTGAGCGGGACGACCAGATGTACCGAGAGCGGCTGCGCACCTTGCTG
GTCATCGCGGTTGTCATGAGCCTCCTGAATGCTCTCAGCACCAGCGGAGGCAGCATTTCCTGGAACGACTTTGTC
CACGAGATGCTGGCCAAGGGCGAGGTGCAGCGCGTCCAGGTGGTGCCTGAGAGCGACGTGGTGGAAGTCTACCTG
CACCCTGGAGCCGTGGTGTTTGGGCGGCCTCGGCTAGCCTTGATGTACCGAATGCAGGTTGCAAATATTGACAAG
TTTGAAGAGAAGCTTCGAGCAGCTGAAGATGAGCTGAATATCGAGGCCAAGGACAGGATCCCAGTTTCCTACAAG
CGAACAGGATTCTTTGGAAATGCCCTGTACTCTGTGGGGATGACGGCAGTGGGCCTGGCCATCCTGTGGTATGTT
TTCCGTCTGGCCGGGATGACTGGAAGGGAAGGTGGATTCAGTGCTTTTAATCAGCTTAAAATGGCTCGTTTCACC
ATTGTGGATGGGAAGATGGGGAAAGGAGTCAGCTTCAAAGACGTGGCAGGAATGCACGAAGCCAAACTGGAAGTC
CGCGAGTTTGTGGATTATCTGAAGAGCCCAGAACGCTTCCTCCAGCTTGGCGCCAAGGTCCCAAAGGGCGCACTG
CTGCTCGGCCCCCCCGGCTGTGGGAAGACGCTGCTGGCCAAGGCGGTGGCCACGGAGGCTCAGGTGCCCTTCCTG
GCGATGGCCGGCCCAGAGTTCGTGGAGGTCATTGGAGGCCTCGGCGCTGCCCGTGTGCGGAGCCTCTTTAAGGAA
GCCCGAGCCCGGGCCCCCTGCATCGTCTACATCGATGAGATCGACGCGGTGGGCAAGAAGCGCTCCACCACCATG
TCCGGCTTCTCCAACACGGAGGAGGAGCAGACGCTCAACCAGCTTCTGGTAGAAATGGATGGAATGGGTACCACA
GACCATGTCATCGTCCTGGCGTCCACGAACCGAGCTGACATTTTGGACGGTGCTCTGATGAGGCCAGGCCGACTG
GACCGGCACGTCTTCATTGATCTCCCCACGCTGCAGGAGAGGCGGGAGATTTTTGAGCAGCACCTGAAGAGCCTG
AAGCTGACCCAGTCCAGCACCTTTTACTCCCAGCGTCTGGCAGAGCTGACACCAGGATTCAGTGGGGCTGACATC
GCCAACATCTGCAATGAGGCTGCGCTGCACGCGGCGCGGGAGGGACACACTTCCGTGCACACTCTCAACTTCGAG
TACGCCGTGGAGCGCGTCCTCGCAGGGACTGCCAAAAAGAGCAAGATCCTGTCCAAGGAAGAACAGAAAGTGGTT
GCGTTTCATGAGTCGGGCCACGCCTTGGTGGGCTGGATGCTGGAGCACACGGAGGCCGTGATGAAGGTCTCCATA
ACCCCTCGGACAAACGCCGCCCTGGGCTTTGCTCAGATGCTCCCCAGAGACCAGCACCTCTTCACCAAGGAGCAG
CTGTTTGAGCGGATGTGCATGGCCTTGGGAGGACGGGCCTCGGAAGCACTGTCCTTCAACGAGGTCACTTCTGGG
GCACAGGACGACCTGAGGAAGGTCACCCGCATCGCCTACTCCATGGTGAAGCAGTTTGGGATGGCACCTGGCATC
GGGCCCATCTCCTTCCCTGAGGCGCAGGAGGGCCTCATGGGCATCGGGCGGCGCCCCTTCAGCCAAGGCCTGCAG
CAGATGATGGACCATGAAGCAAGACTGCTGGTGGCCAAGGCCTACAGACACACCGAGAAGGTGCTGCAGGACAAC
CTGGACAAGTTGCAGGCGCTGGCAAACGCCCTTCTGGAAAAGGAAGTGATAAACTATGAGGACATTGAGGCTCTC
ATTGGCCCGCCGCCCCATGGGCCGAAGAAAATGATCGCACCGCAGAGGTGGATCGACGCCCAGAGGGAGAAACAG
GACTTGGGCGAGGAGGAGACCGAAGAGACCCAGCAGCCTCCACTTGGAGGCGAAGAGCCGACTTGGCCCAAGTAG

TTGGGAGGTGTTGGCTGCACGTGCGGGTGGTCCGGGAAGTGAGGGCTCACTCAGCCACCCTGAGTTGCTTTTCAG
CTGAGGTTTGCACTTCCTCTCGCGGCCCTCAGTAGTCCCTGCACAGTGACTTCTGAGATCTGTTGATTGATGACC
CTTTTCATGATTTTAAGTTTCTCTGCAGAAACTACTGACGGAGTCCTGTGTTTGTGAGTCGTTTCCCCTATGGGG
AAGGTTATCAGTGCTTCCCGAGTGAGCATGGAACACTTCGAGTTCCCAGGGTTATAGACAGTCGTTCCCAGTGTG
GCTGAGGCCACCCAGAGGCAGCAGAGCATTCAGACTCCAAACAGACCCCTGTTCATGCCGACGCTTGCACGACCG
CCCCAGTTCCTGTGGCTCCCTCGGAATGCTAAGGGATCGGACATGAAAGGACCCTGTGAGCCGATTGTCCTATC
TCCAGCGGCCCTGTCATCCAGCTCACTCATCAATGGGCCAGTCAGGCCCAGGCACTGGGCTCCGGAGGACTCAC
CACTGCCCCCTGCTGCCATGTGGACTGGTGCAAGTTGAGGACTTCTTGCTGGTCTAGTCACGCATGCAGTGTTGG
GGATGCCTTGGTTTTTACTGCTCTGAGAATTGTTGAGATACTTTACTAATAAACTGTGTAGTTGGAAAAAAAAAA
AAAAAAAAAAA
```

FIGURE 504

MAVLLLLLRALRRGPGPGPRPLWGPGPAWSPGFPARPGRGRPYMASRPPGDLAEAGGRALQSLQLRLLTPTFEGI
NGLLLKQHLVQNPVRLWQLLGGTFYFNTSRLKQKNKEKDKSKGKAPEEDEEERRRRERDDQMYRERLRTLLVIAV
VMSLLNALSTSGGSISWNDFVHEMLAKGEVQRVQVVPESDVVEVYLHPGAVVFGRPRLALMYRMQVANIDKFEEK
LRAAEDELNIEAKDRIPVSYKRTGFFGNALYSVGMTAVGLAILWYVFRLAGMTGREGGFSAFNQLKMARFTIVDG
KMGKGVSFKDVAGMHEAKLEVREFVDYLKSPERFLQLGAKVPKGALLLGPPGCGKTLLAKAVATEAQVPFLAMAG
PEFVEVIGGLGAARVRSLFKEARARAPCIVYIDEIDAVGKKRSTTMSGFSNTEEEQTLNQLLVEMDGMGTTDHVI
VLASTNRADILDGALMRPGRLDRHVFIDLPTLQERREIFEQHLKSLKLTQSSTFYSQRLAELTPGFSGADIANIC
NEAALHAAREGHTSVHTLNFEYAVERVLAGTAKKSKILSKEEQKVVAFHESGHALVGWMLEHTEAVMKVSITPRT
NAALGFAQMLPRDQHLFTKEQLFERMCMALGGRASEALSFNEVTSGAQDDLRKVTRIAYSMVKQFGMAPGIGPIS
FPEAQEGLMGIGRRPFSQGLQQMMDHEARLLVAKAYRHTEKVLQDNLDKLQALANALLEKEVINYEDIEALIGPP
PHGPKKMIAPQRWIDAQREKQDLGEEETEETQQPPLGGEEPTWPK

FIGURE 505

```
TTTCAGGCCAACATGGCCGTGCTGCTGCTGCTGCTCCGTGCCCTCCGCCGGGGTCCAGGCCCGGGTCCTCGGCCG
CTGTGGGGCCCAGGCCCGGCCTGGAGTCCAGGGTTCCCCGCCAGGCCCGGGAGGGGGCGGCCGTACATGGCCAGC
AGGCCTCCGGGGGACCTCGCCGAGGCTGGAGGCCGAGCTCTGCAGAGCTTACAATTGAGACTGCTAACCCCTACC
TTTGAAGGGATCAACGGATTGTTGTTGAAACAACATTTAGTTCAGAATCCAGTCAGACTCTGGCAACTTTTAGGT
GGTACTTTCTATTTTAACACCTCAAGGTTGAAGCAGAAGAATAAGGAGAAGGATAAGTCGAAGGGGAAGGCGCCT
GAAGAGGACGAAGAGGAGAGGAGACGCCGTGAGCGGGACGACCAGATGTACCGAGAGCGGCTGCGCACCTTGCTG
GTCATCGCGGTTGTCATGAGCCTCCTGAATGCTCTCAGCACCAGCGGAGGCAGCATTTCCTGGAACGACTTTGTC
CACGAGATGCTGGCCAAGGGCGAGGTGCAGCGCGTCCAGGTGGTGCCTGAGAGCGACGTGGTGGAAGTCTACCTG
CACCCTGGAGCCGTGGTGTTTGGGCGGCCTCGGCTAGCCTTGATGTACCGAATGCAGGTTGCAAATATTGACAAG
TTTGAAGAGAAGCTTCGAGCAGCTGAAGATGAGCTGAATATCGAGGCCAAGGACAGGATCCCAGTTTCCTACAAG
CGAACAGGATTCTTTGGAAATGCCCTGTACTCTGTGGGGATGACGGCAGTGGGCCTGGCCATCCTGTGGTATGTT
TTCCGTCTGGCCGGGATGACTGGAAGGGAAGGTGGATTCAGTGCTTTTAATCAGCTTAAAATGGCTCGTTTCACC
ATTGTGGATGGGAAGATGGGGAAAGGAGTCAGCTTCAAAGACGTGGCAGGAATGCACGAAGCCAAACTGGAAGTC
CGCGAGTTTGTGGATTATCTGAAGAGCCCAGAACGCTTCCTCCAGCTTGGCGCCAAGGTCCCAAAGGGCGCACTG
CTGCTCGGCCCCCCCGGCTGTGGGAAGACGCTGCTGGCCAAGGCGGTGGCCACGGAGGCTCAGGTGCCCTTCCTG
GCGATGGCCGGCCCAGAGTTCGTGGAGGTCATTGGAGGCCTCGGCGCTGCCCGTGTGCGGAGCCTCTTTAAGGAA
GCCCGAGCCCGGGCCCCCTGCATCGTCTACATCGATGAGATCGACGCGGTGGGCAAGAAGCGCTCCACCACCATG
TCCGGCTTCTCCAACACGGAGGAGGAGCAGACGCTCAACCAGCTTCTGGTAGAAATGGATGGAATGGGTACCACA
GACCATGTCATCGTCCTGGCGTCCACGAACCGAGCTGACATTTTGGACGGTGCTCTGATGAGGCCAGGCCGACTG
GACCGGCACGTCTTCATTGATCTCCCCACGCTGCAGGAGAGGCGGGAGATTTTTGAGCAGCACCTGAAGAGCCTG
AAGCTGACCCAGTCCAGCACCTTTTACTCCCAGCGTCTGGCAGAGCTGACACCAGGATTCAGTGGGGCTGACATC
GCCAACATCTGCAATGAGGCTGCGCTGCACGCGGCGCGGGAGGGACACACTTCCGTGCACACTCTCAACTTCGAG
TACGCCGTGGAGCGCGTCCTCGCAGGGACTGCCAAAAAGAGCAAGATCCTGTCCAAGGAAGAACAGAAAGTGGTT
GCGTTTCATGAGTCGGGCCACGCCTTGGTGGGCTGGATGCTGGAGCACACGGAGGCCGTGATGAAGGTCTCCATA
ACCCCTCGGACAAACGCCGCCCTGGGCTTTGCTCAGATGCTCCCCAGAGACCAGCACCTCTTCACCAAGGAGCAG
CTGTTTGAGCGGATGTGCATGGCCTTGGGAGGACGGGCCTCGGAAGCACTGTCCTTCAACGAGGTCACTTCTGGG
GCACAGGACGACCTGAGGAAGGTCACCCGCATCGCCTACTCCATGGTGAAGCAGTTTGGGATGGCACCTGGCATC
GGGCCCATCTCCTTCCCTGAGGCGCAGGAGGGCCTCATGGGCATCGGGCGGCGCCCCTTCAGCCAAGGCCTGCAG
CAGATGATGGACCATGAAGCAAGACTGCTGGTGGCCAAGGCCTACAGACACACCGAGAAGGTGCTGCAGGACAAC
CTGGACAAGTTGCAGGCGCTGGCAAACGCCCTTCTGGAAAAGGAAGTGATAAACTATGAGGACATTGAGGCTCTC
ATTGGCCCGCCGCCCCATGGGCCGAAGAAAATGATCGCACCGCAGAGGTGGATCGACGCCCAGAGGGAGAAACAG
GACTTGGGCGAGGAGGAGACCGAAGAGACCCAGCAGCCTCCACTTGGAGGCGAAGAGCCGACTTGGCCCAAGTAG

TTGGGAGGTGTTGGCTGCACGTGCGGGTGGTCCGGGAAGTGAGGGCTCACTCAGCCACCCTGAGTTGCTTTTCAG
CTGAGGTTTGCACTTCCTCTCGCGGCCCTCAGTAGTCCCTGCACAGTGACTTCTGAGATCTGTTGATTGATGACC
CTTTTCATGATTTTAAGTTTCTCTGCAGAAACTACTGACGGAGTCCTGTGTTTGTGAGTCGTTTCCCCTATGGGG
AAGGTTATCAGTGCTTCCCGAGTGAGCATGGAACACTTCGAGTTCCCAGGGTTATAGACAGTCGTTCCCAGTGTG
GCTGAGGCCACCCAGAGGCAGCAGAGCATTCAGACTCCAAACAGACCCCTGTTCATGCCGACGCTTGCACGACCG
CCCCAGTTCCTGTGGCTCCCTCGGAATGCTAAGGGATCGGACATGAAAGGACCCTGTGAGCCGATTGTCCTATC
TCCAGCGGCCCTGTCATCCAGCTCACTCATCAATGGGGCCAGTCAGGCCCAGGCACTGGGCTCCGGAGGACTCAC
CACTGCCCCTGCTGCCATGTGGACTGGTGCAAGTTGAGGACTTCTTGCTGGTCTAGTCACGCATGCAGTGTTGG
GGATGCCTTGGTTTTTACTGCTCTGAGAATTGTTGAGATACTTTACTAATAAACTGTGTAGTTGGAAAAAAAAAA
AAAAAAAAAAAA
```

FIGURE 506

```
MAVLLLLLRALRRGPGPGPRPLWGPGPAWSPGFPARPGRGRPYMASRPPGDLAEAGGRALQSLQLRLLTPTFEGI
NGLLLKQHLVQNPVRLWQLLGGTFYFNTSRLKQKNKEKDKSKGKAPEEDEEERRRRERDDQMYRERLRTLLVIAV
VMSLLNALSTSGGSISWNDFVHEMLAKGEVQRVQVVPESDVVEVYLHPGAVVFGRPRLALMYRMQVANIDKFEEK
LRAAEDELNIEAKDRIPVSYKRTGFFGNALYSVGMTAVGLAILWYVFRLAGMTGREGGFSAFNQLKMARFTIVDG
KMGKGVSFKDVAGMHEAKLEVREFVDYLKSPERFLQLGAKVPKGALLLGPPGCGKTLLAKAVATEAQVPFLAMAG
PEFVEVIGGLGAARVRSLFKEARARAPCIVYIDEIDAVGKKRSTTMSGFSNTEEEQTLNQLLVEMDGMGTTDHVI
VLASTNRADILDGALMRPGRLDRHVFIDLPTLQERREIFEQHLKSLKLTQSSTFYSQRLAELTPGFSGADIANIC
NEAALHAAREGHTSVHTLNFEYAVERVLAGTAKKSKILSKEEQKVVAFHESGHALVGWMLEHTEAVMKVSITPRT
NAALGFAQMLPRDQHLFTKEQLFERMCMALGGRASEALSFNEVTSGAQDDLRKVTRIAYSMVKQFGMAPGIGPIS
FPEAQEGLMGIGRRPFSQGLQQMMDHEARLLVAKAYRHTEKVLQDNLDKLQALANALLEKEVINYEDIEALIGPP
PHGPKKMIAPQRWIDAQREKQDLGEEETEETQQPPLGGEEPTWPK
```

FIGURE 507

```
GCACGAGGGACTGGGGCGGCCACGCACTCCGCCAGAAGGTCGCCAGGAGCCTCCGCCCTTCACCTTCCTCGGAAA
TCCGCCAGGCCACGCAAGCTCCCTGCCCAACCCTTACTGACGGGGGCCACATTTTCCCGGCCTCCGCAGCCAGAC
CTTGACACAAAGGACATCAAACTGCCGAGGGTAAAAACCCCGGAAGGGCGGACACCTCCACATCGCCTTTTGCCA
CCTTTCCCTTTATTTCCGGAGATATTTATTGAGTGTCTACTGTGTGCCAGGCACTATATCTATGTGCATAGAAAA
ACCCTGGAAGGCCATACAACAATATATATAGAGTGATCGTCTCTGCTTGCTGAGCTAACAGGGGTGTCAAGCTTC
CATTTGGTATCTACTTCTAAATACACTCAGAACAGGAGAAATTTGGACTAATTTTCAAACTACAGACACTTTCT
AATCATGATGCATTTCAAAAGTGGACTCGAATTAACTGAGTTGCAAAACATGACAGTGCCCGAGGATGATAACAT
TAGCAATGACTCCAATGATTTCACCGAAGTAGAAAATGGTCAGATAAATAGCAAGTTTATTTCTGATCGTGAAAG
TAGAAGAAGTCTCACAAACAGCCATTTGGAAAAAAAGAAGTGTGATGAGTATATTCCAGGTACAACCTCCTTAGG
CATGTCTGTTTTTAACCTAAGCAACGCCATTATGGGCAGTGGGATTTTGGGACTCGCCTTTGCCCTGGCAAACAC
TGGAATCCTACTTTTTCTGGTACTTTTGACTTCAGTGACATTGCTGTCTATATATTCAATAAACCTCCTATTGAT
CTGTTCAAAAGAAACAGGCTGCATGGTGTATGAAAAGCTGGGGGAACAAGTCTTTGGCACCACAGGGAAGTTCGT
AATCTTTGGAGCCACCTCTCTACAGAACACTGGAGCAATGCTGAGCTACCTCTTCATCGTAAAAAATGAACTACC
CTCTGCCATAAAGTTTCTAATGGGAAAGGAAGAGACATTTTCAGCCTGGTACGTGGATGGCCGCGTTCTGGTGGT
GATAGTTACCTTTGGCATAATTCTCCCTCTGTGTCTCTTGAAGAACTTAGGGTATCTTGGCTATACTAGTGGATT
TTCCTTGAGCTGTATGGTTTTTTTCCTAATTGTGGTTATTTACAAGAAATTTCAAATTCCCTGCATTGTTCCAGA
GCTAAATTCAACAATAAGTGCTAATTCAACAAATGCTGACACGTGTACGCCAAAATATGTTACCTTCAATTCAAA
GACCGTGTATGCTTTACCCACCATTGCATTTGTTTGCCACCCGTCAGTCCTGCCAATTTACAGTGAGCT
TAAAGACCGATCACAGAAAAAAATGCAGATGGTTTCAAACATCTCCTTTTTCGCCATGTTGTTATGTACTTCTT
GACTGCCATTTTTGGCTACTTGACATTCTATGACAACGTGCAGTCCGACCTCCTTCACAAATATCAGAGTAAAGA
TGACATTCTCATCCTGACAGTGCGGCTGGCTGTCATTGTTGCTGTGATCCTCACAGTGCCGGTGTTATTTTTCAC
GGATCGTTCATCTTTATTTGAACTGGCTAAGAAAACAAAGTTTAATTTATGTCGTCATACCGTGGTTACCTGCAT
ACTCTTGGTTGTTATCAACTTGTTGGTGATCTTCATACCCTCCATGAAGGATATTTTTGGAGTCGTAGGAGTTAC
ATCTGCTAACATGCTTATTTTCATTCTTCCTTCATCTCTTTATTTAAAAATCACAACCAGGATGGAGATAAAGGA
ACTCAAAGAATTTGGGCTGCCCTTTTCTTGGGCCTGGGGGTGTTGTTCTCCTTGGTCAGCATTCCCTTGGTCATC
TATGACTGGGCCTGCTCATCGAGTAATGGTGAAGGCCACTGAAACCCGCCGAGAAAAAGAAACATCCCTGTTGTC
TGCTCAGTCAAGTCCCCACACATCAGCAATCTCTCACCACTTCTTTTGCAAGTTTACAGAAGCAAACAGAAATGT
ACAGGATACTTAAAATGGAATAACTTTTTGGTTGCAAAACAGAGACATGGTTCTATAATGCTTCATGTCCCTCCA
AGATTTGAGATCAATTTAGGGATTGTGAAATTTTTTTTCAAATTTCATACAATCATATTTCCCAGTACTTTTCA
CAATCATTTTTTACCCATCTAACTCTATGTTTGTGGCTTCCCGGTCTCTTAGAACTTTGAAAACATGATATACA
ATAATGTTTATTTATTATACATCCAGATTCTGAAATAATTTTCCTACTGATGTTCAGCTCACACTATCTGTACCT
TTTTAGAAGAGAAAAGAATCTTGAATTGTATATATTTATTTTGCTTTACAGAAAAAAATGGTTTCGTAAATAATT
TGCCTATTTTGGGTAACATAGCACATGGAGATAATCATCTGAAAGTTATAGGGCACTGCCACTGCTGAATCAGAG
CATGCCCAATATTTGAGGTGGCTCTGATTTCCTGGCAGCTGAACTCGGGTAGTCCAGTGGCCTAGCTGGTACCAC
ATCTATTCCCATCCAGAGACATTCTCTGGCAAGTGTTCTCAGCTGAAAAGTGGTTGGGGATGATTCTTACCTTGG
TAATTAAATGAAGCTACACATTTGGGTAATCTAGCAAATGAAGTATTTTTCCCTCTTGGCAACTTGTGTCAGAG
TTACTCTGGTCTGAGTCAACTTTCGCTGGGGAAAACCTATGGAACCTACTGCAAAAAGATTGTCCAAAATGCCTA
AGAAAATACTCCTCTGATGCATTTAGCCTTCAACCCTACCTGTCTTGCTGAAGGGAGAAAAATGTTTTAGTACAT
TATAGGCCCAGCAGCTTTTATTCATGTCCACCAGCTAGTTGCACAGAGAATCATGTGTACCTAACTAAGGATGAT
CTAGGATAAGTAACTCCTGTTTTATATTGAGTATTTTAGGGAAGTCTTTAAAAGACTTGTTTTATATCTATAAAT
CTAGGTTATTACAAATACAAGAATTTTGTACCTTAAATAAGCCTCATTTCTATTTCTTCTTCATTAATTCTCCAT
CTAGTCTTGTGAAAAAAAAAAAAAAAAAAA
```

FIGURE 508

MMHFKSGLELTELQNMTVPEDDNISNDSNDFTEVENGQINSKFISDRESRRSLTNSHLEKKKCDEYIPGTTSLGM
SVFNLSNAIMGSGILGLAFALANTGILLFLVLLTSVTLLSIYSINLLLICSKETGCMVYEKLGEQVFGTTGKFVI
FGATSLQNTGAMLSYLFIVKNELPSAIKFLMGKEETFSAWYVDGRVLVVIVTFGIILPLCLLKNLGYLGYTSGFS
LSCMVFFLIVVIYKKFQIPCIVPELNSTISANSTNADTCTPKYVTFNSKTVYALPTIAFAFVCHPSVLPIYSELK
DRSQKKMQMVSNISFFAMFVMYFLTAIFGYLTFYDNVQSDLLHKYQSKDDILILTVRLAVIVAVILTVPVLFFTD
RSSLFELAKKTKFNLCRHTVVTCILLVVINLLVIFIPSMKDIFGVVGVTSANMLIFILPSSLYLKITTRMEIKEL
KEFGLPFSWAWGCCSPWSAFPWSSMTGPAHRVMVKATETRREKETSLLSAQSSPHTSAISHHFFCKFTEANRNVQ
DT

FIGURE 509A

```
GACCTGAGCGACTGCGGCCGCGTCTTCCCGGTCTCCTTTCCCGGCCGCACAGGGTTTTATAGGATCACATTGACA
AAAGTACCATGGAGTTTTATGAGTCAGCATATTTTATTGTTCTTATTCCTCCAATAGTTATTACAGTAATTTTCC
TCTTCTTCTGGCTTTTCATGAAAGAAACATTATATGATGAAGTTCTTGCAAAACAGAAAAGAGAACAAAAGCTTA
TTCCTACCAAAACAGATAAAAAGAAAGCAGAAAAGAAAAAGAATAAAAAGAAAGAAATCCAGAATGGAAACCTCC
ATGAATCCGACTCTGAGAGTGTACCTCGAGACTTTAAATTATCAGATGCTTTGGCAGTAGAAGATGATCAAGTTG
CACCTGTTCCATTGAATGTCGTTGAAACTTCAAGTAGTGTTAGGGAAAGAAAAAAGAAGGAAAAGAAACAAAAGC
CTGTGCTTGAAGAGCAGGTCATCAAAGAAAGTGACGCATCAAAGATTCCTGGCAAAAAAGTAGAACCTGTCCCAG
TTACTAAACAGCCCACCCCTCCCTCTGAAGCAGCTGCCTCGAAGAAGAAACCAGGGCAGAAGAAGTCTAAAAATG
GAAGCGATGACCAGGATAAAAAGGTGGAAACTCTCATGGTACCATCAAAAAGGCAAGAAGCATTGCCCCTCCACC
AAGAGACTAAACAAGAAAGTGGATCAGGGAAGAAGAAAGCTTCATCAAAGAAACAAAAGACAGAAAATGTCTTCG
TAGATGAACCCCTTATTCATGCAACTACTTATATTCCTTTGATGGATAATGCTGACTCAAGTCCTGTGGTAGATA
AGAGAGAGGTTATTGATTTGCTTAAACCTGACCAAGTAGAAGGGATCCAGAAATCTGGGACTAAAAAACTGAAGA
CCGAAACTGACAAAGAAAATGCTGAAGTGAAGTTTAAAGATTTTCTTCTGTCCTTGAAGACTATGATGTTTTCTG
AAGATGAGGCTCTTTGTGTTGTAGACTTGCTAAAGGAGAAGTCTGGTGTAATACAAGATGCTTTAAAGAAGTCAA
GTAAGGGAGAATTGACTACGCTTATACATCAGCTTAAGAAAAGGACAAGTTACTCGCTGCTGTGAAGGAAGATG
CTGCTGCTACAAAGGATCGGTGTAAGCAGTTAACCCAGGAAATGATGACAGAGAAAGAAAGAAGCAATGTGGTTA
TAACAAGGATGAAAGATCGAATTGGAACATTAGAAAAGGAACATAATGTATTTCAAAACAAAATACATGTCAGTT
ATCAAGAGACTCAACAGATGCAGATGAAGTTTCAGCAAGTTCGTGAGCAGATGGAGGCAGAGATAGCTCACTTGA
AGCAGGAAAATGGTATACTGAGAGATGCAGTCAGCAACACTACAAATCAACTGGAAAGCAAGCAGTCTGCAGAAC
TAAATAAACTACGCCAGGATTATGCTAGGTTGGTGAATGAGCTGACTGAGAAAACAGGAAAGCTACAGCAAGAGG
AAGTCCAAAAGAAGAATGCTGAGCAAGCAGCTACTCAGTTGAAGGTTCAACTACAAGAAGCTGAGAGAAGGTGGG
AAGAAGTTCAGAGCTACATCAGGAAGAGAACAGCGGAACATGAGGCAGCACAGCAAGATTTACAGAGTAAATTTG
TGGCCAAAGAAAATGAAGTACAGAGTCTGCATAGTAAGCTTACAGATACCTTGGTATCAAAACAACAGTTGGAGC
AAAGACTAATGCAGTTAATGGAATCAGAGCAGAAAAGGGTGAACAAAGAAGAGTCTCTACAAATGCAGGTTCAGG
ATATTTTGGAGCAGAATGAGGCTTTGAAAGCTCAAATTCAGCAGTTCCATTCCCAGATAGCAGCCCAGACCTCCG
CTTCAGTTCTAGCAGAAGAATTACATAAAGTGATTGCAGAAAAGGATAAGCAGATAAAACAGACTGAAGATTCTT
TAGCAAGTGAACGTGATCGTTTAACAAGTAAAGAAGAGGAACTTAAGGATATACAGAATATGAATTTCTTATTAA
AAGCTGAAGTGCAGAAATTACAGGCCCTGGCAAATGAGCAGGCTGCTGCTGCACATGAATTGGAGAAGATGCAAC
AAAGTGTTTATGTTAAAGATGATAAAATAAGATTGCTGGAAGAGCAACTACAACATGAAATTTCAAACAAAATGG
AAGAATTTAAGATTCTAAATGACCAAAACAAAGCATTAAAATCAGAAGTTCAGAAGCTACAGACTCTTGTTTCTG
AACAGCCTAATAAGGATGTTGTGGAACAAATGGAAAAATGCATTCAAGAAAAAGATGAGAAGTTAAAGACTGTGG
AAGAATTACTTGAAACTGGACTTATTCAGGTGGCAACTAAAGAAGAGGAGCTGAATGCAATAAGAACAGAAAATT
CATCTCTGACAAAAGAAGTTCAAGACTTAAAAGCTAAGCAAAATGATCAGGTTTCTTTTGCCTCTCTAGTTGAAG
AACTTAAGAAAGTGATCCATGAGAAAGATGGAAAGATCAAGTCTGTAGAAGAGCTTCTGGAGGCAGAACTTCTCA
AAGTTGCTAACAAGGAGAAAACTGTTCAGGATTTGAAACAGGAAATAAAGGCTCTAAAAGAAGAAATAGGAAATG
TCCAGCTTGAAAAGGCTCAACAGTTATCTATCACTTCCAAAGTTCAGGAGCTTCAGAACTTATTAAAAGGAAAAG
AGGAACAGATGAATACCATGAAGGCTGTTTTGGAAGAGAAAGAGAAAGACCTAGCCAATACAGGGAAGTGGTTAC
AGGATCTTCAAGAAGAAATGAATCTTTAAAAGCACATGTTCAGGAAGTAGCACAACATAACTTGAAAGAGGCCT
CTTCTGCATCACAGTTTGAAGAACTTGAGATTGTGTTGAAAGAAAAGGAAAATGAATTGAAGAGGTTAGAAGCCA
TGCTAAAAGAGAGGGAGAGTGATCTTTCTAGCAAAACACAGCTGTTACAGGATGTACAAGATGAAAACAAATTGT
TTAAGTCCCAAATTGAGCAGCTTAAACAACAAAACTACCAACAGGCATCTTCTTTTCCCCCTCATGAAGAATTAT
TAAAAGTAATTTCAGAAAGAGAGAAAGAAATAAGTGGTCTCTGGAATGAGTTAGATTCTTTGAAGGATGCAGTTG
AACACCAGAGGAAGAAAAACAATGAAAGGCAGCAACAGGTGGAAGCTGTTGAGTTGGAGGCTAAAGAAGTTCTCA
AAAAATTATTTCCAAAGGTGTCTGTCCCTTCTAATTTGAGTTATGGTGAATGGTTGCATGGATTTGAAAAAAAGG
CAAAAGAATGTATGGCTGGAACTTCAGGGTCAGAGGAGGTTAAGGTTCTAGAGCACAAGTTGAAAGAAGCTGATG
AAATGCACACATTGTTACAGCTAGAGTGTGAAAAATACAAATCCGTCCTTGCAGAAACAGAAGGAATTTTACAGA
AGCTACAGAGAAGTGTTGAGCAAGAAGAAAATAAATGGAAAGTTAAGGTCGATGAATCACACAAGACTATTAAAC
AGATGCAGTCATCATTTACATCTTCAGAACAAGAGCTAGAGCGATTAAGAAGCGAAAATAAGGATATTGAAAATC
```

FIGURE 509B

```
TGAGAAGAGAACGAGAACATTTGGAAATGGAACTAGAAAAGGCAGAGATGGAACGATCTACCTATGTTACAGAAG
TCAGAGAGTTGAAGGCACAGTTAAATGAAACACTCACAAAACTTAGAACTGAACAAAATGAAAGACAGAAGGTAG
CTGGTGATTTGCATAAGGCTCAACAGTCACTGGAGCTTATCCAGTCAAAAATAGTAAAAGCTGCTGGAGACACTA
CTGTTATTGAAAATAGTGATGTTTCCCCAGAAACGGAGTCTTCTGAGAAGGAGACAATGTCTGTAAGTCTAAATC
AGACTGTAACACAGTTACAGCAGTTGCTTCAGGCGGTAAACCAACAGCTCACAAAGGAGAAAGAGCACTACCAGG
TGTTAGAGTGAAGTAATTGGGAAACTGTTCATTTGAGGATAAAAAAGGCATTGTATTATATTTTGCCAAATTAAA
GCCTTATTTATGTTTTCACCCTTTCTACTTTGTCAGAAACACTGAACAGAGTTTTGTCTTTTCTAATCCTTGTTA
GACTACTGATTTAAAGAAGGAAAAAAAAAGCCAACTCTGTAGACACCTTCAGAGTTTAGTTTTATAATAAAAACT
GTTTGAATAATTAGACCTTTACATTCCTGAAGATAAACATGTAATCTTTTATCTTATTTTGCTCAATAAAATTGT
TCAGAAGATCAAAGTGGTAAAGACAATGTAAAATTTAACATTTTAATACTGATGTTGTACACTGTTTTACTTAAC
ATTTGGGAAGTAACTGCCTCTGACTTCAACTCAAGAAAACACTTTTTTGTTGCTAATGTAATCGGTTTTTGTAA
TGGCGTCACAAATAAAAGGATGCTTATTATTC
```

FIGURE 510

MEFYESAYFIVLIPPIVITVIFLFFWLFMKETLYDEVLAKQKREQKLIPTKTDKKKAEKKKNKKKEIQNGNLHES
DSESVPRDFKLSDALAVEDDQVAPVPLNVVETSSSVRERKKKEKKQKPVLEEQVIKESDASKIPGKKVEPVPVTK
QPTPPSEAAASKKKPGQKKSKNGSDDQDKKVETLMVPSKRQEALPLHQETKQESGSGKKKASSKKQKTENVFVDE
PLIHATTYIPLMDNADSSPVVDKREVIDLLKPDQVEGIQKSGTKKLKTETDKENAEVKFKDFLLSLKTMMFSEDE
ALCVVDLLKEKSGVIQDALKKSSKGELTTLIHQLQEKDKLLAAVKEDAAATKDRCKQLTQEMMTEKERSNVVITR
MKDRIGTLEKEHNVFQNKIHVSYQETQQMQMKFQQVREQMEAEIAHLKQENGILRDAVSNTTNQLESKQSAELNK
LRQDYARLVNELTEKTGKLQQEEVQKKNAEQAATQLKVQLQEAERRWEEVQSYIRKRTAEHEAAQQDLQSKFVAK
ENEVQSLHSKLTDTLVSKQQLEQRLMQLMESEQKRVNKEESLQMQVQDILEQNEALKAQIQQFHSQIAAQTSASV
LAEELHKVIAEKDKQIKQTEDSLASERDRLTSKEEELKDIQNMNFLLKAEVQKLQALANEQAAAAHELEKMQQSV
YVKDDKIRLLEEQLQHEISNKMEEFKILNDQNKALKSEVQKLQTLVSEQPNKDVVEQMEKCIQEKDEKLKTVEEL
LETGLIQVATKEEELNAIRTENSSLTKEVQDLKAKQNDQVSFASLVEELKKVIHEKDGKIKSVEELLEAELLKVA
NKEKTVQDLKQEIKALKEEIGNVQLEKAQQLSITSKVQELQNLLKGKEEQMNTMKAVLEEKEKDLANTGKWLQDL
QEENESLKAHVQEVAQHNLKEASSASQFEELEIVLKEKENELKRLEAMLKERESDLSSKTQLLQDVQDENKLFKS
QIEQLKQQNYQQASSFPPHEELLKVISEREKEISGLWNELDSLKDAVEHQRKKNNERQQQVEAVELEAKEVLKKL
FPKVSVPSNLSYGEWLHGFEKKAKECMAGTSGSEEVKVLEHKLKEADEMHTLLQLECEKYKSVLAETEGILQKLQ
RSVEQEENKWKVKVDESHKTIKQMQSSFTSSEQELERLRSENKDIENLRREREHLEMELEKAEMERSTYVTEVRE
LKAQLNETLTKLRTEQNERQKVAGDLHKAQQSLELIQSKIVKAAGDTTVIENSDVSPETESSEKETMSVSLNQTV
TQLQQLLQAVNQQLTKEKEHYQVLE

FIGURE 511

```
GACGGAAGTGCGGTGTTGAGCGCCGGCGGCTCGCGCCCACGCTGGGCCGGGAGTCGAAATGCTTCCCGGTGCCGG
GAGTGAGCGATGAGCTGGCTTCTGTTCCTGGCCCACAGAGTCGCCTTGGCCGCCTTGCCCTGCCGCCGCGGCTCT
CGCGGGTTCGGGATGTTCTATGCCGTGAGGAGGGGCCGCAAGACCGGGGTCTTTCTGACCTGGAATGAGTGCAGA
GCACAGGTGGACCGGTTTCCTGCTGCCAGATTTAAGAAGTTTGCCACAGAGGATGAGGCCTGGGCCTTTGTCAGG
AAATCTGCAAGCCCGGAAGTTTCAGAAGGGCATGAAAATCAACATGGACAAGAATCGGAGGCGAAAGCCAGCAAG
CGACTCCGTGAGCCACTGGATGGAGATGGACATGAAAGCGCAGAGCCGTATGCAAAGCACATGAAGCCGAGCGTG
GAGCCGGCGCCTCCAGTTAGCAGAGACACGTTTTCCTACATGGGAGACTTCGTCGTCGTCTACACTGATGGCTGC
TGCTCCAGTAATGGGCGTAGAAGGCCGCGAGCAGGAATCGGCGTTTACTGGGGGCCAGGCCATCCTTTAAATGTA
GGCATTAGACTTCCTGGGCGGCAGACAAACCAAAGAGCGGAAATTCATGCAGCCTGCAAAGCCATTGAACAAGCA
AAGACTCAAAACATCAATAAACTGGTTCTGTATACAGACAGTATGTTTACGATAAATGGTATAACTAACTGGGTT
CAAGGTTGGAAGAAAAATGGGTGGAAGACAAGTGCAGGGAAAGAGGTGATCAACAAAGAGGACTTTGTGGCACTG
GAGAGGCTTACCCAGGGGATGGACATTCAGTGGATGCATGTTCCTGGTCATTCGGGATTTATAGGCAATGAAGAA
GCTGACAGATTAGCCAGAGAAGGAGCTAAACAATCGGAAGACTGAGCCATGTGACTTTAGTCCTTGGGAGAACTT
GAGCCAGCGGCTGTCTTGCTGCCTGTACTTACTGGTGTGGAAAATAGCCTGCAGGTAGGACCATTGCAGTGATGG
GCAGATGCGTCTTTCACACGGAATCAGGCACAGTGGCCTTCTGTGACATGTGTTTATAAAAAATGGTTAAGTATA
TAATAAATTGAACATCTTTGAGATTGGAGAATTATGTGAGATTTCCACATTATGTTTACTGGGTTCAATACTGTC
CTTGCTTGTTTTATTGCAGGCAAGCAAGGCAAATGGCCTAAAATGCTGTGGCTTATATTTTGATAAGAAATCAAA
AAACCATTGGTTAAAAGATGCAACTCAGAAGTCTGGAAGTATTCTGAAAGCATCCATTTACCGTCCAGTTGACAG
GTTTGAGTCTCCTGCTTGTATAGGTGACTTGTGCCCATGGGTACATTAAAGGAACATGCTGCCCAGGGCCTGGGC
GGACAGCTCAGTGGGCAGGATGTGTGCTGGGTCTCAGCCCCATGTGCCTGCTTGCTGGGCAGTTAGTATAGGGCA
AAGCCTGCCTGCGGCGACCCTGGCTGCTAGGCCATTCTCTAGGAACAGCTGCGACTCATAAAGACCAAGAAGCAT
AAATAAACTTTCAAAAATTTATTTGGCTCTTTCGTTAAAAACTGTGCAATCAAAAAAAATCTATGTCGGGTGCGG
AGAAAGAGGTAATGAAATGGCA
```

FIGURE 512

MSWLLFLAHRVALAALPCRRGSRGFGMFYAVRRGRKTGVFLTWNECRAQVDRFPAARFKKFATEDEAWAFVRKSA
SPEVSEGHENQHGQESEAKASKRLREPLDGDGHESAEPYAKHMKPSVEPAPPVSRDTFSYMGDFVVVYTDGCCSS
NGRRRPRAGIGVYWGPGHPLNVGIRLPGRQTNQRAEIHAACKAIEQAKTQNINKLVLYTDSMFTINGITNWVQGW
KKNGWKTSAGKEVINKEDFVALERLTQGMDIQWMHVPGHSGFIGNEEADRLAREGAKQSED

FIGURE 513

```
CCATGGCTCAGCCTCTGGGTCCAGAGCCTCAGCTCCTACCTCTTCCCTCCTTGCCAGCCCCTGATGCCTGCCAGA
CTTTTGCCTCTGCTGGAGCCCCTGCCTGACCAGCTTCCCCTCCCTGTCTGGTTGGGATTTGGGGGCTGAGCTGTC
TGGGGTCCCAGGGCCAACCAATGCAGTGCCGGCTCCCGCGGGGCCTGGCTGGAGCCCTCCTCACCCTCCTGTGCA
TGGGGCTCCTGTGTCTGCGGTACCACTTGAACCTGTCCCCGCAGCGGGTACAAGGGACCCCCGAGCTGAGCCAGC
CGAACCCGGGGCCCCCTAAGCTACAGCTACACGATGTCTTCATTGCAGTGAAGACGACCCGGGCTTTCCACCGCT
TGCGCCTGGAGCTGCTGCTTGACACGTGGGTTTCCAGGACCAGGGAACAGACATTTGTCTTCACCGACAGCCCAG
ACAAAGGCCTCCAGGAGAGACTGGGGTCCCACCTTGTGGTCACCAACTGCTCCGCGGAACACAGCCACCCAGCTC
TGTCCTGCAAGATGGCTGCTGAGTTCGACACCTTCTTGGCCAGTGGGCTTAGGTGGTTCTGCCATGTGGACGATG
ACAACTATGTGAACCCAAGGGCGCTGCTGCAGCTTCTGAGAGCCTTCCCGCTGGCCCGCGACGTCTATGTGGGAA
GGCCCAGCCTGAACCGGCCCATCCATGCCTCAGAGCCACAGCCCCACAACCGCACGAGGCTGGTACAGTTCTGGT
TGCCACTGGGGGTGCTGGCTTCTGCATCAATCGCAAACTGGCTTTGAAGATGGCTCCGTGGGCCAGTGGCTCCC
GTTTCATGGACACATCTGCTCTCATCCGGCTGCCTGATGACTGCACCATGGGCTATATCATTGAGTGCAAGCTGG
GCGGCCGCCTGCAGCCCAGCCCCCTCTTTCACTCCCACCTGGAGACCCTGCAGCTGCTGAGGACTGCACAGCTCC
CAGAACAGGTCACCCTCAGCTACGGTGTCTTTGAGGGGAAACTCAACGTCATTAAGCTACAGGGCCCCTTCTCCC
CGGAGGAGGACCCCTCCAGATTTCGCTCCCTCCATTGTCTGCTCTATCCAGATACACCCTGGTGTCCCCAGCTGG
GTGCCCGATGAATCCTGAACTGCTGGGCAAAGGTTGGGCAGAGACTTCTGGGTGTGCCTTGGCTCCCAAGGTGGC
ACTGTGGGTCCCTGGCAAGTGTCTTGTGATAGGCAGTCCCTGGCAGGGCCTTCGGGTGGTTGGCAAGCCCAGGAT
CTGAGTGGCAATTGGCACTGAAGGCACCCCAGGCCCCTGGGAGGTGAGTTAGACAGCCCAGGGGACCAGGTGGAC
CAGGTGGTGGCCAGAGAGGCTCCAGGGGCTAGACTCCCTCAGGAGGCTGAATTGAAAAAGGGCAGGGGGCACTTG
AGCTGGGCTGGGGCTCAGGGGTCCTAACCCTTAGGCAGTGACATGGCCTCTGGGTGGGGTCTGGCCGTTGGCCC
TGGCTAATGTCTCTCAGTCATTCCCCTGGGGCTCAAGCGCTGGGCCGCCCACTCCTGCCTCCCTCATCTGTGTCC
CGAGTTCTGAAGGGACATGGGTGGAATGATGGCAGAATCCAGGGTCTGCAGCACCTGCTGTTGTTGCCAACCAG
TCTCCCAAAGCTCCTTGCTCCCCACCCCTTGCGAACAGGACCAGATTTTGTTTGGAGCCTCAGCATGCCGGGGCC
CAGATGATGGAGCATAACGGGTCCCAGCCAATTGTGATGATCCTTTTTGCTCATTTCCCAGCCTTTCTTGCTGTT
AGGGGCTACCATGGGACCAGCTCTGGCCAGAGGGAACTAAGCAAATCCAATAGAGATGTTTCTGGGGAAGGTTTT
GCAGCCCACTCCCCATCTTCCTGCTATAAATGTGGGTGTGATGGCTGGATCTGGGGCAGCCACCTTGCTACCATG
AAGGAAAGGCCAAGACAATCATCCACAGCTATTCCCTCCAGCATCTGGTTCTGTACAAAAATTAAATGCTTATTT
GTTTAAGTCAAAAAA
```

FIGURE 514

MQCRLPRGLAGALLTLLCMGLLCLRYHLNLSPQRVQGTPELSQPNPGPPKLQLHDVFIAVKTTRAFHRLRLELLL
DTWVSRTREQTFVFTDSPDKGLQERLGSHLVVTNCSAEHSHPALSCKMAAEFDTFLASGLRWFCHVDDDNYVNPR
ALLQLLRAFPLARDVYVGRPSLNRPIHASEPQPHNRTRLVQFWFATGGAGFCINRKLALKMAPWASGSRFMDTSA
LIRLPDDCTMGYIIECKLGGRLQPSPLFHSHLETLQLLRTAQLPEQVTLSYGVFEGKLNVIKLQGPFSPEEDPSR
FRSLHCLLYPDTPWCPQLGAR

FIGURE 515

```
AAAGACAAACTGCACCCACTGAACTCCGCAGCTAGCATCCAAATCAGCCCTTGAGATTTGAGGCCTTGGAGACTC
AGGAGTTTTGAGAGCAAAATGACAACACCCAGAAATTCAGTAAATGGGACTTTCCCGGCAGAGCCAATGAAAGGC
CCTATTGCTATGCAATCTGGTCCAAAACCACTCTTCAGGAGGATGTCTTCACTGGTGGGCCCCACGCAAAGCTTC
TTCATGAGGGAATCTAAGACTTTGGGGGCTGTCCAGATTATGAATGGGCTCTTCCACATTGCCCTGGGGGGTCTT
CTGATGATCCCAGCAGGGATCTATGCACCCATCTGTGTGACTGTGTGGTACCCTCTCTGGGGAGGCATTATGTAT
ATTATTTCCGGATCACTCCTGGCAGCAACGGAGAAAAACTCCAGGAAGTGTTTGGTCAAAGGAAAAATGATAATG
AATTCATTGAGCCTCTTTGCTGCCATTTCTGGAATGATTCTTTCAATCATGGACATACTTAATATTAAAATTTCC
CATTTTTAAAAATGGAGAGTCTGAATTTTATTAGAGCTCACACACCATATATTAACATATACAACTGTGAACCA
GCTAATCCCTCTGAGAAAAACTCCCCATCTACCCAATACTGTTACAGCATACAATCTCTGTTCTTGGGCATTTTG
TCAGTGATGCTGATCTTTGCCTTCTTCCAGGAACTTGTAATAGCTGGCATCGTTGAGAATGAATGGAAAAGAACG
TGCTCCAGACCCAAATCTAACATAGTTCTCCTGTCAGCAGAAGAAAAAAAAGAACAGACTATTGAAATAAAAGAA
GAAGTGGTTGGGCTAACTGAAACATCTTCCCAACCAAAGAATGAAGAAGACATTGAAATTATTCCAATCCAAGAA
GAGGAAGAAGAAGAAACAGAGACGAACTTTCCAGAACCTCCCCAAGATCAGGAATCCTCACCAATAGAAAATGAC
AGCTCTCCTTAAGTGATTTCTTCTGTTTCTGTTTCCTTTTTTAAACATTAGTGTTCATAGCTTCCAAGAGACAT
GCTGACTTTCATTTCTTGAGGTACTCTGCACATACGCACCACATCTCTATCTGGCCTTTGCATGGAGTGACCATA
GCTCCTTCTCTCTTACATTGAATGTAGAGAATGTAGCCATTGTAGCAGCTTGTGTTGTCACGCTTCTTCTTTTGA
GCAACTTTCTTACACTGAAGAAAGGCAGAATGAGTGCTTCAGAATGTGATTTCCTACTAACCTGTTCCTTGGATA
GGCTTTTTAGTATAGTATTTTTTTTTGTCATTTTCTCCATCAGCAACCAGGGAGACTGCACCTGATGGAAAAGAT
ATATGACTGCTTCATGACATTCCTAAACTATCTTTTTTTATTCCACATCTACGTTTTTGGTGGAGTCCCTTTTT
ATCATCCTTAAAACAATGATGCAAAAGGGCTTTAGAGCACAATGGATCT
```

FIGURE 516

MTTPRNSVNGTFPAEPMKGPIAMQSGPKPLFRRMSSLVGPTQSFFMRESKTLGAVQIMNGLFHIALGGLLMIPAG
IYAPICVTVWYPLWGGIMYIISGSLLAATEKNSRKCLVKGKMIMNSLSLFAAISGMILSIMDILNIKISHFLKME
SLNFIRAHTPYINIYNCEPANPSEKNSPSTQYCYSIQSLFLGILSVMLIFAFFQELVIAGIVENEWKRTCSRPKS
NIVLLSAEEKKEQTIEIKEEVVGLTETSSQPKNEEDIEIIPIQEEEEETETNFPEPPQDQESSPIENDSSP

FIGURE 517

```
CACTCGGAGCCCGAGCCCGAGCCGCAGCCGCCGCCTGGGGCGCTTGGGTCGGCCTCGAGGACACCGGAGAGGGGC
GCCACGCCGCCGTGGCCGCAGAAATGACCATGGTTGACACAGAGATGCCATTCTGGCCCACCAACTTTGGGATCA
GCTCCGTGGATCTCTCCGTAATGGAAGACCACTCCCACTCCTTTGATATCAAGCCCTTCACTACTGTTGACTTCT
CCAGCATTTCTACTCCACATTACGAAGACATTCCATTCACAAGAACAGATCCAGTGGTTGCAGATTACAAGTATG
ACCTGAAACTTCAAGAGTACCAAAGTGCAATCAAAGTGGAGCCTGCATCTCCACCTTATTATTCTGAGAAGACTC
AGCTCTACAATAAGCCTCATGAAGAGCCTTCCAACTCCCTCATGGCAATTGAATGTCGTGTCTGTGGAGATAAAG
CTTCTGGATTTCACTATGGAGTTCATGCTTGTGAAGGATGCAAGGGTTTCTTCCGGAGAACAATCAGATTGAAGC
TTATCTATGACAGATGTGATCTTAACTGTCGGATCCACAAAAAAGTAGAAATAAATGTCAGTACTGTCGGTTTC
AGAAATGCCTTGCAGTGGGGATGTCTCATAATGCCATCAGGTTTGGGCGGATGCCACAGGCCGAGAAGGAGAAGC
TGTTGGCGGAGATCTCCAGTGATATCGACCAGCTGAATCCAGAGTCCGCTGACCTCCGGGCCCTGGCAAAACATT
TGTATGACTCATACATAAAGTCCTTCCCGCTGACCAAAGCAAAGGCGAGGGCGATCTTGACAGGAAAGACAACAG
ACAAATCACCATTCGTTATCTATGACATGAATTCCTTAATGATGGGAGAAGATAAAATCAAGTTCAAACACATCA
CCCCCCTGCAGGAGCAGAGCAAAGAGGTGGCCATCCGCATCTTTCAGGGCTGCCAGTTTCGCTCCGTGGAGGCTG
TGCAGGAGATCACAGAGTATGCCAAAAGCATTCCTGGTTTTGTAAATCTTGACTTGAACGACCAAGTAACTCTCC
TCAAATATGGAGTCCACGAGATCATTTACACAATGCTGGCCTCCTTGATGAATAAAGATGGGGTTCTCATATCCG
AGGGCCAAGGCTTCATGACAAGGGAGTTTCTAAAGAGCCTGCGAAAGCCTTTTGGTGACTTTATGGAGCCCAAGT
TTGAGTTTGCTGTGAAGTTCAATGCACTGGAATTAGATGACAGCGACTTGGCAATATTTATTGCTGTCATTATTC
TCAGTGGAGACCGCCCAGGTTTGCTGAATGTGAAGCCCATTGAAGACATTCAAGACAACCTGCTACAAGCCCTGG
AGCTCCAGCTGAAGCTGAACCACCCTGAGTCCTCACAGCTGTTTGCCAAGCTGCTCCAGAAAATGACAGACCTCA
GACAGATTGTCACGGAACACGTGCAGCTACTGCAGGTGATCAAGAAGACGGAGACAGACATGAGTCTTCACCCGC
TCCTGCAGGAGATCTACAAGGACTTGTACTAGCAGAGAGTCCTGAGCCACTGCCAACATTTCCCTTCTTCCAGTT
GCACTATTCTGAGGGAAAATCTGACACCTAAGAAATTTACTGTGAAAAGCATTTAAAAAGAAAAGGTTTTAGA
ATATGATCTATTTTATGCATATTGTTTATAAAGACACATTTACAATTTACTTTTAATATTAAAAATTACCATATT
ATGAAATTGC
```

FIGURE 518

MVDTEMPFWPTNFGISSVDLSVMEDHSHSFDIKPFTTVDFSSISTPHYEDIPFTRTDPVVADYKYDLKLQEYQSA
IKVEPASPPYYSEKTQLYNKPHEEPSNSLMAIECRVCGDKASGFHYGVHACEGCKGFFRRTIRLKLIYDRCDLNC
RIHKKSRNKCQYCRFQKCLAVGMSHNAIRFGRMPQAEKEKLLAEISSDIDQLNPESADLRALAKHLYDSYIKSFP
LTKAKARAILTGKTTDKSPFVIYDMNSLMMGEDKIKFKHITPLQEQSKEVAIRIFQGCQFRSVEAVQEITEYAKS
IPGFVNLDLNDQVTLLKYGVHEIIYTMLASLMNKDGVLISEGQGFMTREFLKSLRKPFGDFMEPKFEFAVKFNAL
ELDDSDLAIFIAVIILSGDRPGLLNVKPIEDIQDNLLQALELQLKLNHPESSQLFAKLLQKMTDLRQIVTEHVQL
LQVIKKTETDMSLHPLLQEIYKDLY

FIGURE 519

```
GCGCCCGCGCCTCGGGCCGTCGGGAGCGGAGCCTCCTCGGGACCAGGACTTCAGGGCCACAGGTGCTGCCAAGAT
GCTCCAGGGCACCTGCTCCGTGCTCCTGCTCTGGGGAATCCTGGGGGCCATCCAGGCCCAGCAGCAGGAGGTCAT
CTCGCCGGACACTACCGAGAGAAACAACAACTGCCCAGAGAAGACCGACTGCCCCATCCACGTGTACTTCGTGCT
GGACACCTCGGAGAGCGTCACCATGCAGTCCCCCACGGACATCCTGCTCTTCCACATGAAGCAGTTCGTGCCGCA
GTTCATCAGCCAGCTGCAGAACGAGTTCTACCTGGACCAGGTGGCGCTGAGCTGGCGCTACGGCGGCCTGCACTT
CTCTGACCAGGTGGAGGTGTTCAGCCCACCGGGCAGCGACCGGGCCTCCTTCATCAAGAACCTGCAGGGCATCAG
CTCCTTCCGCCGCGGCACCTTCACCGACTGCGCGCTGGCCAACATGACGGAGCAGATCCGGCAGGACCGCAGCAA
GGGCACCGTCCACTTCGCCGTGGTCATCACCGACGGCCACGTCACCGGCAGCCCCTGCGGGGGCATCAAGCTGCA
GGCCGAGCGGGCCCGCGAGGAGGGCATCCGGCTCTTCGCCGTGGCCCCCAACCAGAACCTGAAGGAGCAGGGCCT
GCGGGACATCGCCAGCACGCCGCACGAGCTCTACCGCAACGACTACGCCACCATGCTGCCCGACTCCACCGAGAT
CAACCAGGACACCATCAACCGCATCATCAAGGTCATGAAACACGAAGCCTACGAGAGTGCTACAAGGTGAGCTG
CCTGGAAATCCCTGGGCCCTCTGGGCCCAAGGGCTACCGTGGACAGAAGGGTGCCAAGGGCAACATGGGTGAGCC
GGGAGAGCCTGGCCAGAAGGGAAGACAGGGAGACCCGGGCATCGAAGGCCCCATTGGATTCCCAGGACCCAAGGG
CGTTCCTGGCTTCAAAGGAGAGAAGGGTGAATTTGGAGCCGACGGTCGCAAGGGGGCCCCTGGCCTGGCTGGCAA
GAACGGGACCGATGGACAGAAGGGCAAGCTGGGGCGCATCGGACCTCCTGGCTGCAAGGGAGACCCTGGAAACCG
GGGCCCCGACGGTTACCCGGGGGAAGCAGGGAGTCCAGGGGAGCGAGGAGACCAAGGCGGCAAGGGGGACCCTGG
CCGCCCAGGACGCAGAGGGCCCCCGGGAGAAATCGGGGCCAAGGGAAGCAAGGGGTATCAAGGCAACAATGGAGC
CCCAGGAAGTCCTGGTGTGAAAGGAGCCAAGGGCGGGCCTGGGCCCGCGGACCCAAAGGCGAGCCGGGCGCAG
GGGAGACCCCGGCACCAAGGGCAGCCCAGGCAGCGATGGCCCCAAGGGGGAGAAGGGGGACCCTGGCCCTGAGGG
CCCCCGCGGCCTGGCTGGAGAGGTTGGCAACAAAGGAGCCAAGGGAGACCGAGGCTTGCCTGGACCCAGAGGCCC
CCAGGGAGCTCTTGGGGAGCCCGGAAAGCAGGGATCTCGGGGAGACCCCGGTGATGCAGGACCCCGTGGAGACTC
AGGACAGCCAGGCCCCAAGGGAGACCCCGGCAGGCCTGGATTCAGCTACCCAGGACCCCGAGGAGCACCCGGAGA
AAAAGGCGAGCCCGGCCCACGCGGCCCCGAGGGAGGCCGAGGCGACTTTGGCTTGAAAGGAGAACCTGGGAGGAA
AGGAGAGAAAGGAGAGCCTGCGGATCCTGGTCCCCCTGGTGAGCCAGGCCCTCGGGGCCAAGAGGAGTCCCAGG
ACCCGAGGGTGAGCCCGGCCCCCCTGGAGACCCCGGTCTCACGGAGTGTGACGTCATGACCTACGTGAGGGAGAC
CTGCGGGTGCTGCGACTGTGAGAAGCGCTGTGGCGCCCTGGACGTGGTCTTCGTCATCGACAGCTCCGAGAGCAT
TGGGTACACCAACTTCACACTGGAGAAGAACTTCGTCATCAACGTGGTCAACAGGCTGGGTGCCATCGCTAAGGA
CCCCAAGTCCGAGACAGGGACGCGTGTGGGCGTGGTGCAGTACAGCCACGAGGGCACCTTTGAGGCCATCCAGCT
GGACGACGAACATATCGACTCCCTGTCGAGCTTCAAGGAGGCTGTCAAGAACCTCGAGTGGATTGCGGGCGGCAC
CTGGACACCCTCAGCCCTCAAGTTTGCCTACGACCGCCTCATCAAGGAGAGCCGGCGCCAGAAGACACGTGTGTT
TGCGGTGGTCATCACGGACGGGCGCCACGACCCTCGGGACGATGACCTCAACTTGCGGGCGCTGTGCGATCGCGA
CGTCACAGTGACGGCCATCGGCATCGGGGACATGTTCCACGAGAAGCACGAGAGTGAAAACCTCTACTCCATCGC
CTGCGACAAGCCACAGCAGGTGCGCAACATGACGCTGTTCTCCGACCTGGTCGCTGAGAAGTTCATCGATGACAT
GGAGGACGTCCTCTGCCCGGACCCTCAGATCGTGTGCCCAGACCTTCCCTGCCAAACAGAGCTGTCCGTGGCACA
GTGCACGCAGCGGCCCGTGGACATCGTCTTCCTGCTGGACGGCTCCGAGCGGCTGGGTGAGCAGAACTTCCACAA
GGCCCGGCGCTTCGTGGAGCAGGTGGCGCGGCGGCTGACGCTGGCCCGGAGGGACGACGACCCTCTCAACGCACG
CGTGGCGCTGCTGCAGTTTGGTGGCCCCGGCGAGCAGCAGGTGGCCTTCCCGCTGAGCCACAACCTCACTGCCAT
CCACGAGGCGCTGGAGACCACACAATACCTGAACTCCTTCTCGCACGTGGGCGCAGGCGTGGTGCACGCCATCAA
TGCCATCGTGCGCAGCCCGCGTGGCGGGGCCCGGAGGCACGCAGAGCTGTCCTTCGTGTTCCTCACGGACGGCGT
CACGGGCAACGACAGTCTGCACGAGTCGGCGCACTCCATGCGCAAGCAGAACGTGGTACCCACCGTGCTGGCCTT
GGGCAGCGACGTGGACATGGACGTGCTCACCACGCTCAGCCTGGGTGACCGCGCCGCCGTGTTCCACGAGAAGGA
CTATGACAGCCTGGCGCAACCCGGCTTCTTCGACCGCTTCATCCGCTGGATCTGCTAGCGCCGCCGCCCGGGCCC
CGCAGTCGAGGGTCGTGAGCCCACCCCGTCCATGGTGCTAAGCGGGCCCGGGTCCCACACGGCCAGCACCGCTGC
TCACTCGGACGACGCCCTGGGCCTGCACCTCTCCAGCTCCTCCCACGGGGTCCCCGTAGCCCCGGCCCCGCCCA
GCCCCAGGTCTCCCCAGGCCCTCCGCAGGCTGCCCGGCCTCCCTCCCCCTGCAGCCATCCCAAGGCTCCTGACCT
ACCTGGCCCCTGAGCTCTGGAGCAAGCCCTGACCCAATAAAGGCTTTGAACCCAAAAAAAAAAA
```

FIGURE 520

MLQGTCSVLLLWGILGAIQAQQQEVISPDTTERNNNCPEKTDCPIHVYFVLDTSESVTMQSPTDILLFHMKQFVP
QFISQLQNEFYLDQVALSWRYGGLHFSDQVEVFSPPGSDRASFIKNLQGISSFRRGTFTDCALANMTEQIRQDRS
KGTVHFAVVITDGHVTGSPCGGIKLQAERAREEGIRLFAVAPNQNLKEQGLRDIASTPHELYRNDYATMLPDSTE
INQDTINRIIKVMKHEAYGECYKVSCLEIPGPSGPKGYRGQKGAKGNMGEPGEPGQKGRQGDPGIEGPIGFPGPK
GVPGFKGEKGEFGADGRKGAPGLAGKNGTDGQKGKLGRIGPPGCKGDPGNRGPDGYPGEAGSPGERGDQGGKGDP
GRPGRRGPPGEIGAKGSKGYQGNNGAPGSPGVKGAKGGPGPRGPKGEPGRRGDPGTKGSPGSDGPKGEKGDPGPE
GPRGLAGEVGNKGAKGDRGLPGPRGPQGALGEPGKQGSRGDPGDAGPRGDSGQPGPKGDPGRPGFSYPGPRGAPG
EKGEPGPRGPEGGRGDFGLKGEPGRKGEKGEPADPGPPGEPGPRGPRGVPGPEGEPGPPGDPGLTECDVMTYVRE
TCGCCDCEKRCGALDVVFVIDSSESIGYTNFTLEKNFVINVVNRLGAIAKDPKSETGTRVGVVQYSHEGTFEAIQ
LDDEHIDSLSSFKEAVKNLEWIAGGTWTPSALKFAYDRLIKESRRQKTRVFAVVITDGRHDPRDDDLNLRALCDR
DVTVTAIGIGDMFHEKHESENLYSIACDKPQQVRNMTLFSDLVAEKFIDDMEDVLCPDPQIVCPDLPCQTELSVA
QCTQRPVDIVFLLDGSERLGEQNFHKARRFVEQVARRLTLARRDDDPLNARVALLQFGGPGEQQVAFPLSHNLTA
IHEALETTQYLNSFSHVGAGVVHAINAIVRSPRGGARRHAELSFVFLTDGVTGNDSLHESAHSMRKQNVVPTVLA
LGSDVDMDVLTTLSLGDRAAVFHEKDYDSLAQPGFFDRFIRWIC

FIGURE 521

```
ACGCGCTCTTAGACCATGGCGACCCAGGCGAAGCGTCCACGGGTGGCGGGGCCCGTGGACGGCGGCGACCTGGAT
CCTGTGGCCTGCTTCCTGAGCTGGTGCCGGCGGGTGGGGCTGGAGCTGAGTCCCAAGGTGGCGGTCAGCCGGCAG
GGCACGGTGGCCGGCTACGGCATGGTGGCCCGGGAGAGCGTGCAGGCCGGAGAGCTGCTGTTCGTGGTGCCGCGG
GCCGCGCTCCTGTCGCAGCACACCTGCTCCATCGGCGGCCTGCTGGAGCGAGAGCGAGTTGCGCTGCAGGGCCAG
TCGGGCTGGGTGCCACTGCTGCTGGCGCTGCTCCACGAGCTGCAGGCCCCGGCCTCACGCTGGAGGCCCTACTTT
GCGCTCTGGCCCGAGCTGGGCCGCTTGGAGCACCCGATGTTCTGGCCAGAGGAGGAGCGCCGGTGCCTGCTCCAG
GGCACAGGCGTACCTGAGGCCGTGGAGAAGGATTTGGCCAACATCCGCAGCGAGTACCAGTCCATCGTGCTGCCC
TTCATGGAAGCCCACCCCGATCTCTTCAGCCTCAGGGTTCGCTCCCTAGAACTCTACCACCAGCTGGTGGCCCTT
GTGATGGCCTATAGCTTTCAGGTACCACTGGAGGAAGAAGAGGATGAAAAGGAGCCCAACTCCCCGTGATGGTG
CCTGCTGCAGACATACTAAACCACTTAGCCAATCACAACGCCAATCTAGAATACTCTGCGAATTGTCTTCGGATG
GTAGCCACTCAGCCCATTCCTAAAGGCCATGAGATTTTCAACACTTATGGGCAAATGGCTAACTGGCAACTGATT
CATATGTACGGTTTTGTTGAACCATATCCTGACAACACAGATGACACAGCTGACATTCAGATGGTGACAGTTCGT
GAGGCAGCATTACAGGGAACAAAAACTGAAGCTGAAAGGCACCTAGTGTACGAGCGCTGGGATTTCCTATGCAAA
CTGGAGATGGTAGGGGAAGAGGGAGCCTTTGTGATAGGGAGGGAGGAGGTGCTGACTGAAGAGGAGCTGACCACC
ACACTAAAGGTACTGTGCATGCCTGCTGAGGAGTTCAGAGAGCTTAAAGACCAGGATGGAGGGGGAGATGATAAA
AGGGAAGAGGGCAGCCTGACGATCACAAATATTCCCAAGCTCAAAGCATCGTGGAGACAGCTGCTTCAAAACAGT
GTTCTACTGACTTTGCAGACCTATGCCACAGACTTAAAAACTGACCAAGGTTTACTCAGTAATAAGGAAGTCTAT
GCGAAACTCAGCTGGAGGGAACAGCAAGCCTTACAGGTTCGCTATGGTCAGAAGATGATCTTACATCAGTTGTTG
GAACTGACAAGTTAGCAGTTTCCCTGTTCCCTGAAGGAACAGCAATAAGAACTTTATTCTAAGCTAATACTCATT
GATGTTTGAAAAGAGGAAAATTTGGATCTTTCTTTTGCTTACTAAACACCAAGAGGAAAAGTAGCAAAGTTGGT
GTGCTAGGATTAACTCAGGTAAGGGTGATGTGTTTTAGGATTGAGAACAGCAGACTTGGGAATCACTGCTAATTG
TTACTTAAAGCATGTTACAGCTGTTTTGTTCTCAGTTTTAACCAAAGCCAGTGGACATACGGTAGTAATAACTAA
GTCTTGTTGTGTTTCAGCATTTAATAATAGACTTTGGAGGTAGACCCCTGGTTTAAATCTAAGTCTAGTTTGAGG
AAGTCACTTAACCTTTATTGAAAAGACTCTGGATTTAATAAGCTGTGTAACTGGTACTCGATAGTTACCCAAAGT
TCAGTCTAGATGGCACAAACCACCTCTCAGGGAATAAACCCTAAGACATCACTCAAGGAGGACTTCAATTATTTA
ATTTGAACTGTTTGTCCTCTCTGGCCATAAAACTTGACAGTCATGAAAGGTAAGGCAAATTTTAAGTGGGTTA
AGTTTTTAAATACGTATCTACTCATTTCTTTAAAAAAAAAAAAAAAAAA
```

FIGURE 522

```
MATQAKRPRVAGPVDGGDLDPVACFLSWCRRVGLELSPKVAVSRQGTVAGYGMVARESVQAGELLFVVPRAALLS
QHTCSIGGLLERERVALQGQSGWVPLLLALLHELQAPASRWRPYFALWPELGRLEHPMFWPEEERRCLLQGTGVP
EAVEKDLANIRSEYQSIVLPFMEAHPDLFSLRVRSLELYHQLVALVMAYSFQVPLEEEEDEKEPNSPVMVPAADI
LNHLANHNANLEYSANCLRMVATQPIPKGHEIFNTYGQMANWQLIHMYGFVEPYPDNTDDTADIQMVTVREAALQ
GTKTEAERHLVYERWDFLCKLEMVGEEGAFVIGREEVLTEEELTTTLKVLCMPAEEFRELKDQDGGGDDKREEGS
LTITNIPKLKASWRQLLQNSVLLTLQTYATDLKTDQGLLSNKEVYAKLSWREQQALQVRYGQKMILHQLLELTS
```

FIGURE 523

```
CATCCTCCCACCAGGACATCCTTCATCTGCAGCCAGCGCCCCGTCTCATGTAGTGGGCCTCCACCGCCCCCCC
ACCCCCAGTCCCACCTCCACCCACTGGGGCTACCCCACCTCCCCCACCCCCACTGCCAGCCGGAGGAGCCCAGGG
GTCCAGCCACGACGAGAGCTCCATGTCAGGACTGGCCGCTGCCATAGCTGGGGCCAAGCTGAGAAGAGTCCAACG
GCCAGAAGACGCATCTGGAGGCTCCAGTCCCAGTGGGACCTCAAAGTCCGATGCCAACCGGGCAAGCAGCGGGGG
TGGCGGAGGAGGCCTCATGGAGGAAATGAACAAACTGCTGGCCAAGAGGAGAAAAGCAGCCTCCCAGTCAGACAA
GCCAGCCGAGAAGAAGGAAGATGAAAGCCAAATGGAAGATCCTAGTACCTCCCCCTCTCCGGGGACCCGAGCAGC
CAGCCAGCCACCTAACTCCTCAGAGGCTGGCCGGAAGCCCTGGGAGCGGAGCAACTCGGTGGAGAAGCCTGTGTC
CTCGATTCTGTCCAGAACCCCGTCTGTGGCAAAGAGCCCCGAAGCTAAGAGCCCCCTTCAGTCGCAGCCTCACTC
TAGGTACCGAACAACCCTCCTGCTCACATGTCCCCCAGGGTTTGGGGCTCCTCTGTCCCCCGTCCCGTGACTAAC
ACCCTTGCACGCTGTCTCACGTCCTGGCATTTAACAACTTGCTCTGCGAAGGTGGTCTGTTCTTTCAGACCCAGG
ACCTCGGGGTCCTGTCAGTCAGCTGCTCCGTCTTTTCCCTCTGAGAGAGAGACCAAGGGCAAGGAGGGCAGTGAC
CTGTCCACAGAGGTAGTGCAGGGGGGGCCAACATGGAGTCCCAGCTCTGGACTCACTACGTGTGACAGTGGGCAA
GTTAGGGGACCTCTCCAAGCCTCTGTTTTCCCCCCACAAAGTGAGGTCTGTTAACCCCTGCTGCACAGGGTGGTG
GTGGGGACAGCTGTGAGCAACAGCTGGACATGGGGTGTGGTCACTAGCCAGGGCTGCACCCTACAGTTCAACCAG
TCCTAGCACTGGCGCTGAGCCCTACCCCTTTCCTCCAGCCCAGAGTCCTTCCTCTGCGGCCGGCACACAGAATCA
GTTTCCCCACAGACATACTGACCATATTTCCCAAGCCAAAAGCTGGCATGACAACATGATAGAATATTTGGAACT
GAGATTGCCCAAAAAGGCAGAGGCAGCCAGCCACATAGTATCTGGAGGTACATGTGGCCTGAATTGGAAGGCCTC
TAGAACCTGCGTCAAGAATGTCTCCATCGCCACCACAAATTGAAGGGAAACCACCCTTATCACAGAGCAGGAGGC
ATTGAAACTGGCCTTGCAGAGCTGAACAGGTGGTGAGAGCAGAGCAGTGCAGGTGGACAGAGATGAGGAAGTCTT
AGCAGTCAGCTGGGGTTTGTCCAAGGCTTGTGGTCAGCCAGGCCGTGTGCTGGGGACAGTCCCTGCCTGCAAAGA
GCACCGTGTGAACAAGGCCACTGTGGTCCTGAGGGGTGCTCTGGACAGGGTGCAGGGCCACATGGTGGAAGGGAC
AGGGTGCTTTGCGGAGTGGGGTGGGGCAAGCCTCTGTCGGGAGCTGGCATTTTCGTTGACCCGGACGAGGAGGAG
TCTGCTCTGCGGAGATCATGGGGACAGCCTCCCAAGCTGAAGGAAGGGTAAGTGCCAGGGCCCTGAGCCTGCAGC
CACCCGCCAAGCTCCCCCGCACCTCCACCTGGAAGCAGACAGGCCATGGGCAGGGGAACGGGAAGGGTGAGGAA
GAGGGTGTGGGGGAGCGCGGAGTTAGAAGTTTGCATTGTGTTCATGCGCAGGGCCCAGTCATGGAACTTGAGGCA
CAGGGTGCCATGGTGGAGGCTGGGAAGGGGAAGGCAACCAGAGTGGGCAAAACGAGGGCCCTGGAGCAGACACGG
CAGCAAGGGGAGCCTGCAGCGCTCCCAGCGGACTCCGCCACGTCCTGCTGGTGGAGCAAAGGCGGGCTGCCATGT
TGTGAGTGGCCAAGGGTCGCTCACTGGGCAGGAACATTGTCAAGGCCATTCATGCTTGGAATAGGGTCTCTCTTC
AGCTCTGAGGCAAATCTGTTCTCTAATTTTCAGATGACTTCAAGGGGAACGTGTACCACCACCCCTCTGGTGCGT
CACATTGCTTAGGAAGCCTGCTGTGTTTATCACTGGGTGGCTGTCAGGGCTGAGATGGAGAGGGCCAGGGCCTGG
CGAGGTGGAGCAGTCGGCCCAGGTGTCCCAGCAATTGTTGCTGGAACAGGGTCTGGAACCCACAGGAGAGGCCTG
AAGGACCCAGGGCCCTCTGGCTGGATGCGTTTGCCTATCAGGACCCAGAATTACTTACAGACCTGTTTAGGGCTA
GGCTTGGCCTCTTTCTTGAGCTCATCTGGAGGGGTGTGGCAACACTCATTCTTCATCCTTATTCTCCCTGGCTGT
GGGCAACACTGGTCCTCAGTGTCACCAGATGGTCCTCCTCTGTGCCCATGACCCCTCAGCAGCCAAGGCTGGCCC
TGCCAGATAAATGTGTGTGCCCATGATCACACCCAGGGGCACAGGCCACATACGTTTCCCTGAAACCTTGGGCTC
CAGCCTCCATCCCGTCCATGTGGGAGGGAACTTGGGTCCAGCAGTGTGTCTTTCAGCACCAAGTCATGTTTAAA
AGACCAGAGAGACAAGCATTTTGCCAAGATCTTCCAGGGAAGATGCATGTGTGACACATTAACATTCAAATCAGG
CCAGCGCGGTGCTCATGCCTGTCATCCCAGCACTTTGGGAGGCCGAGGCGGGAGGATCACTTGAGCCCAGGACTT
GGAGACCAGTCTGGGCAACACAGTGAGACCCCATCTCTACAAAAAGTCAAAAAAAAAAAAAAAAAAGG
```

FIGURE 524

```
AACTCCTTCAATTTGTAAATCTCTGGTTAAATAGAAAGGTAGCAGATCAGCCCTCCTTGATCTCTGCCAACTTAA
TATTTGAACAGAGATTTAAAGGAAAAAATATTACAGAAGTGGGAATCCTCAAAATACTTTCTAAAACTAGCTTTG
GGCTGGGATTATAGGCATAAGCTACTGCACCCATCTCAGAATTTGTCTATGTTTACAATATTATCAATGGGTAGA
CAGCTAATTGCACAGAATATAAATGAGGAGAGGTAGATTTTTATTAATGTGTACATTTTCCTTAATTCCTGATTT
ACTCAGGCCCAGGCTTCTTTGTTTCTGGTCTTGGATCTATGGGCCTGTGTAAATCTTTGTCACTTAGCTAAAAGG
ATTTCTTGAAAATCCTTGTAGTTGTTTATTGAGCATTTACTGTGTACTAGGCACTATTGTA
```

FIGURE 525

LLQFVNLWLNRKVADQPSLISANLIFEQRFKGKNITEVGILKILSKTSFGLGL

FIGURE 526

```
GGGCAGGTGCAGTTGTAATCGAAATTCACGGAACAGTAGTTCTGGTGTGTCACCTTTATATTCACCAGTGTCTTT
CTGTGGAATTCCTGTAGGAGTGCTACAGAATAAACTCCCAGACCTTTCCTTAGATAACATGANTGGGCAAAGTGC
AATGCTGGGGAAGAACATCCCAGAGGTTCAATTCTGCGGGAAGTGCACCTCAAGTTCCTGCTGACGGGACTGCTT
TCAGGACTGCCCGCACCACAGTTTGCTATTCGTATGTGTCCACCGTTGACCACAAAAAACATCAAGATGTATCAG
CCACTGCTGGCTGTTGGTACAAGTAATGGTTCTGTCCTGGTGTACCATCTCACCAGTGGTCTGCTACACAAAGAG
TTAAGCATCCACTCATGTGAAGTCAAGGGTATTGAATGGACAAGTTTGACTAGTTTTCTTTCTTTGCTACCTCAA
CACCAAACAATATGGGATTAGTGAGAAATGAACTTCAACTGGTTGATCTTCCAACAGGTTTGTTTTTAAAGATCC
AAATAGGTTTGTCATATTGAATAAACATGTTGCCATTTATAAAACATGTTTGAAAGTACTTCTTTCACCTTGGAA
TTTTTTTTAATATTTCATGCTTATATATTTATTCTTTTATTCTCTAATAATTGCCCTAGAAAGGCCTCATCATTG
TTTACATGGAAATGTTGTTGGCACAAATACATGGTAAAATGGAGGACCATTAGCCTGAACAGACAGATTCATTAA
AAAATAGGATACCGGTTCTACTTTTAAGTGCATTGTTATATGTAACCAACTTTAAAAGATCGATTTAAAAATAAC
TCTGTCAATGGACTTTATTAGAGTCTGTGCTGGAAATTTTGGCTTTTATAGGAAACACTTAGAAAATTTATAGGT
TAAGGATTGTTTTTAAATGCTCAAATTTAAAACTTGTAATAGTCTCTGGCTGAATGAATAGAGAAACTTAATTTG
GGATTTTGAAGATTCTACAGTAGGAAACGTCCCAATAAGGTAACTTTTTCAGAATTGAAAGCCTAAACCCAGTGA
ATTTCAAAATAAAGAATTTGAAAATATAATAAGGAAAGAGTTTCAAATTATTTTCTGGTGTATGCAGTAGTTTCA
AAGAGGTTTTTTAAAAATAAAATTGTGATGAGTTTCTTTAAAATGGTATAGCAACACGAATCATATGTAGATGA
TCTTAACCAATGAGAGCATGTGTATGTATGTGTAAAATGAATTAAATCAAATAAATGGTTGTAAATCAAGTAAGT
TGTAAATAAATGAAGTACATGGTTGCTTTTTATGTTCTCCATATGTATTTCAAGCTCTCAAAGATCCAGTTGT
TCTTACTTCTCAGGGTATGTTGCTGAACTTCCAGGAATCATTCCCGTCTTTAGTCCAGTGTTGCTGCTCTAGTCT
CATTGGAAGTGACCTGTCCACTGACTCTCATCCCCAAGTTCCTAATTTGCCAGCAGAATGGTACTGGCCCTGTGT
CTAGTGATCCCAGGGATAAAATGCTGTTGTCTAGTATCATTGACTTAAAAAAAAGAAAAAAAATCCCTGTTTTAT
TTGTTTTGGTCAGCTCAAGTTCAGGACTGTTAGATAACTTAAAATCTGCTTTGCACAGATGTATTTTAAGGAAC
AAACATCTACAGTAACAGTTACAGAT
```

FIGURE 527

GRCSCNRNSRNSSSGVSPLYSPVSFCGIPVGVLQNKLPDLSLDNMXGQSAMLGKNIPEVQFCGKCTSSSC

FIGURE 528

ACTCTTCTGGTCCCCACAGACTCAGAGAGAACCCACCATGGTGCTGTCTCCTGCCGACAAGACCAACGTCAAGGC
CGCCTGGGGTAAGGTCGGCGCGCACGCTGGCGAGTATGGTGCGGAGGCCCTGGAGAGGATGTTCCTGTCCTTCCC
CACCACCAAGACCTACTTCCCGCACTTCGACCTGAGCCACGGCTCTGCCCAGGTTAAGGGCCACGGCAAGAAGGT
GGCCGACGCGCTGACCAACGCCGTGGCGCACGTGGACGACATGCCCAACGCGCTGTCCGCCCTGAGCGACCTGCA
CGCGCACAAGCTTCGGGTGGACCCGGTCAACTTCAAGCTCCTAAGCCACTGCCTGCTGGTGACCCTGGCCGCCCA
CCTCCCCGCCGAGTTCACCCCTGCGGTGCACGCCTCCCTGGACAAGTTCCTGGCTTCTGTGAGCACCGTGCTGAC
CTCCAAATACCGTTAAGCTGGAGCCTCGGTAGCCGTTCCTCCTGCCCGCTGGGCCTCCCAACGGGCCCTCCTCCC
CTCCTTGCACCGGCCCTTCCTGGTCTTTGAATAAAGTCTGAGTGGGCGGC

FIGURE 529

MVLSPADKTNVKAAWGKVGAHAGEYGAEALERMFLSFPTTKTYFPHFDLSHGSAQVKGHGKKVADALTNAVAHVD
DMPNALSALSDLHAHKLRVDPVNFKLLSHCLLVTLAAHLPAEFTPAVHASLDKFLASVSTVLTSKYR

FIGURE 530

```
TTTAAACTGCTAGAAAGGAAGAGCCGAATATTTGGCTGGAGTGATTTTTAGACATTTCTCTACCTTAGGGCACCA
GAGAGGTTCACTTGCCCAGGGTTCCATAGCTGGTTGGTGCCAGAGTCCGAACGAGAAACCAGGTCTTCTCAGCTC
CTGTCACCCACAGTTTTGCAGACACTGAATTTATGAGGTGGATTCCATTCAAGCATGCACATAACTAGCAGACAC
TTCTCCTAATCCTCCTCAATTCCCCTTTGCATTGCTCAGATACCACAATCCTTTGCAGGTTAAATCCCTTCACCT
TGTGAACTCATTAGGCAGGGCAATGTATATGAATCCCTGAGTCCTTAAGAACGTCCTTAGGCTGTGTTAGAAATG
CAGTTGCCATAGGAGTAACCGGCCCCTGCTGTCATTTGGATGTTCTCTCTTCCCCAAAATCCAGCACCACCTTGG
TTAAGCACCCACCATGTGCCTGCCCACCTGGCTCCTTAGGCAATGTTACAATTAACCAGGTTGGTTTTGATGAGG
GTCTAGGGCAAAATTTGAACCACCACAACAGCCAATGTGCACATCCATGCAGAGGGTTCAGAGATGGCCTCGGCC
AAGGATGCCAGGCTTCAGCTCTGGAAGGAGCCCTGGGAGGTGGGAGATCTTTGTATAAAAATTGGAACCCAAACT
ATAATTCCCATTAGGGATATATATGCTCACATCACTCCTGATTCAAAGCTCAGAAGTGGCCTCTCAGGAGAAATA
AAGGTCTCTCTCTCTCTCTCTCTATCTCACACACACACACACACACACACACACAGAGAGAGAGAGAGAGAGA
GAGAGAGAGAGAGAGAGAGAGGCCAGCATTCAAAATTCCCATGCTTAGGGAATCCATTGGGACTTCTCCCCAG
GATGTACTGAATTCAAGGAAGCTTTCTCTAGGTGTAGCAGAAACTGCTGCTGTCATGTCTCTGCTCACCAGGACG
TAGCTTCTCTACAGACCTTTATTTCTTTCCCTGGAGGCTTCAGTCCATGTTGAAGTGTAAACTCCACTCAGCT
CCAGGAGGAATCGTGTTTCTTTATCACCAGGGGCTTCTTCTACGAGTTGCCTTTGATAGGGAGGCCAGGAGGAA
GATAGGCCCAAGCTCAGGGGTGGGATCGGGGAGCAGGAAGCCTGTGGGCTTTAGAATCGAGGTATTGGTTTCTCC
CTGTCACCGTCATCCACCACCTGTGTGAACTTGAGCCATTTATCGAACCTCACGGAGCCCCAAGTTTCTCATCTG
TAAACAAGGGGAATGAGCCCTACTTTGTATGGTTGTCAAGAGGATTTGAGACAATATGTATAAAGCAATGGACAC
GCAGAGGAAGTCAATAAGTACAAGGTAACTCTGAAAATGCCACCAAAGGGAGGCTAGGGACAGGAAAGCCATCTC
CGCCAACCTCAAGAACGTGGCCCCGAAGCTGTTCCAGGAACTGGGCATGTATGAAGATAAAAAAAAAAAAAAAA
```

FIGURE 531

MASAKDARLQLWKEPWEVGDLCIKIGTQTIIPIRDIYAHITPDSKLRSGLSGEIKVSLSLSLYLTHTHTHTHTQR
ERERERERERERPAFKIPMLRESIGTSPQDVLNSRKLSLGVAETAAVMSLLTRT

FIGURE 532

CAGACTCAGAGAGAACCCACCATGGTGCTGTCTCCTGCCGACAAGACCAACGTCAAGGCCGCCTGGGGTAAGGTC
GGCGCGCACGCTGGCGAGTATGGTGCGGAGGCCCTGGAGAGGATGTTCCTGTCCTTCCCCACCACCAAGACCTAC
TTCCCGCACTTCGACCTGAGCCACGGCTCTGCCCAGGTTAAGGGCCACGGCAAGAAGGTGGCCGACGCGCTGACC
AACGCCGTGGCGCACGTGGACGACATGCCCAACGCGCTGTCCGCCCTGAGCGACCTGCACGCGCACAAGCTTCGG
GTGGACCCGGTCAACTTCAAGCTCCTAAGCCACTGCCTGCTGGTGACCCTGGCCGCCCACCTCCCCGCCGAGTTC
ACCCCTGCGGTGCACGCCTCCCTGGACAAGTTCCTGGCTTCTGTGAGCACCGTGCTGACCTCCAAATACCGTTAA
GCTGGAGCCTCGGTGGCCATGCTTCTTGCCCCTTGGGC

FIGURE 533

MVLSPADKTNVKAAWGKVGAHAGEYGAEALERMFLSFPTTKTYFPHFDLSHGSAQVKGHGKKVADALTNAVAHVD
DMPNALSALSDLHAHKLRVDPVNFKLLSHCLLVTLAAHLPAEFTPAVHASLDKFLASVSTVLTSKYR

FIGURE 534A

GCGCGACCGTCCCGGGGGTGGGGCCGGGCGCAGCGGCGAGAGGAGGCGAAGGTGGCTGCGGTAGCAGCAGCGCGG
CAGCCTCGGACCCAGCCCGGAGCGCAGGGCGGCCGCTGCAGGTCCCCGCTCCCCTCCCCGTGCGTCCGCCATGG
CCGCCGCCGGGCAGCTGTGCTTGCTCTACCTGTCGGCGGGGCTCCTGTCCCGGCTCGGCGCAGCCTTCAACTTGG
ACACTCGGGAGGACAACGTGATCCGGAAATATGGAGACCCCGGGAGCCTCTTCGGCTTCTCGCTGGCCATGCACT
GGCAACTGCAGCCCGAGGACAAGCGGCTGTTGCTCGTGGGGCCCCGCGCGGAGAAGCGCTTCCACTGCAGAGAG
CCAACAGAACGGGAGGGCTGTACAGCTGCGACATCACCGCCCGGGGGCCATGCACGCGGATCGAGTTTGATAACG
ATGCTGACCCCACGTCAGAAAGCAAGGAAGATCAGTGGATGGGGGTCACCGTCCAGAGCCAAGGTCCAGGGGGCA
AGGTCGTGACATGTGCTCACCGATATGAAAAAAGGCAGCATGTTAATACGAAGCAGGAATCCCGAGACATCTTTG
GGCGGTGTTATGTCCTGAGTCAGAATCTCAGGATTGAAGACGATATGGATGGGGGAGATTGGAGCTTTTGTGATG
GGCGATTGAGAGGCCATGAGAAATTTGGCTCTTGCCAGCAAGGTGTAGCAGCTACTTTTACTAAAGACTTTCATT
ACATTGTATTTGGAGCCCCGGGTACTTATAACTGGAAAGGGATTGTTCGTGTAGAGCAAAAGAATAACACTTTTT
TTGACATGAACATCTTTGAAGATGGGCCTTATGAAGTTGGTGGAGAGACTGAGCATGATGAAAGTCTCGTTCCTG
TTCCTGCTAACAGTTACTTAGGTTTTTCTTTGGACTCAGGGAAAGGTATTGTTTCTAAAGATGAGATCACTTTTG
TATCTGGTGCTCCCAGAGCCAATCACAGTGGAGCCGTGGTTTTGCTGAAGAGAGACATGAAGTCTGCACATCTCC
TCCCTGAGCACATATTCGATGGAGAAGGTCTGGCCTCTTCATTTGGCTATGATGTGGCGGTGGTGGACCTCAACA
AGGATGGGTGGCAAGATATAGTTATTGGAGCCCCACAGTATTTTGATAGAGATGGAGAAGTTGGAGGTGCAGTGT
ATGTCTACATGAACCAGCAAGGCAGATGGAATAATGTGAAGCCAATTCGTCTTAATGGAACCAAAGATTCTATGT
TTGGCATTGCAGTAAAAAATATTGGAGATATTAATCAAGATGGCTACCCAGATATTGCAGTTGGAGCTCCGTATG
ATGACTTGGGAAAGGTTTTTATCTATCATGGATCTGCAAATGGAATAAATACCAAACCAACACAGGTTCTCAAGG
GTATATCACCTTATTTTGGATATTCAATTGCTGGAAACATGGACCTTGATCGAAATTCCTACCCTGATGTTGCTG
TTGGTTCCCTCTCAGATTCAGTAACTATTTTCAGATCCCGGCCTGTGATTAATATTCAGAAAACCATCACAGTAA
CTCCTAACAGAATTGACCTCCGCCAGAAAACAGCGTGTGGGGCGCCTAGTGGGATATGCCTCCAGGTTAAATCCT
GTTTTGAATATACTGCTAACCCCGCTGGTTATAATCCTTCAATATCAATTGTGGGCACACTTGAAGCTGAAAAG
AAAGAAGAAATCTGGGCTATCCTCAAGAGTTCAGTTTCGAAACCAAGGTTCTGAGCCCAAATATACTCAAGAAC
TAACTCTGAAGAGGCAGAAACAGAAAGTGTGCATGGAGGAAACCCTGTGGCTACAGGATAATATCAGAGATAAAC
TGCGTCCCATTCCCATAACTGCCTCAGTGGAGATCCAAGAGCCAAGCTCTCGTAGGCGAGTGAATTCACTTCCAG
AAGTTCTTCCAATTCTGAATTCAGATGAACCCAAGACAGCTCATATTGATGTTCACTTCTTAAAAGAGGGATGTG
GAGACGACAATGTATGTAACAGCAACCTTAAACTAGAATATAAATTTTGCACCCGAGAAGGAAATCAAGACAAAT
TTTCTTATTTACCAATTCAAAAAGGTGTACCAGAACTAGTTCTAAAAGATCAGAAGGATATTGCTTTAGAAATAA
CAGTGACAAACAGCCCTTCCAACCCAAGGAATCCCACAAAAGATGGCGATGACGCCCATGAGGCTAAACTGATTG
CAACGTTTCCAGACACTTTAACCTATTCTGCATATAGAGAACTGAGGGCTTTCCCTGAGAAACAGTTGAGTTGTG
TTGCCAACCAGAATGGCTCGCAAGCTGACTGTGAGCTCGGAAATCCTTTTAAAAGAAATTCAAATGTCACTTTTT
ATTTGGTTTTAAGTACAACTGAAGTCACCTTTGACACCCCATATCTGGATATTAATCTGAAGTTAGAAACAACAA
GCAATCAAGATAATTTGGCTCCAATTACAGCTAAAGCAAAAGTGGTTATTGAACTGCTTTTATCGGTCTCGGGAG
TTGCTAAACCTTCCCAGGTGTATTTTGGAGGTACAGTTGTTGGCGAGCAAGCTATGAAATCTGAAGATGAAGTGG
GAAGTTTAATAGAGTATGAATTCAGGGTAATAAACTTAGGTAAACCTCTTACAAACCTCGGCACAGCAACCTTGA
ACATTCAGTGGCCAAAAGAAATTAGCAATGGGAAATGGTTGCTTTATTTGGTGAAAGTAGAATCCAAAGGATTGG
AAAAGGTAACTTGTGAGCCACAAAAGGAGATAAACTCCCTGAACCTAACGGAGTCTCACAACTCAAGAAAGAAAC
GGGAAATTACTGAAAAACAGATAGATGATAACAGAAAATTTTCTTTATTTGCTGAAAGAAAATACCAGACTCTTA
ACTGTAGCGTGAACGTGAACTGTGTGAACATCAGATGCCCGCTGCGGGGGCTGGACAGCAAGGCGTCTCTTATTT
TGCGCTCGAGGTTATGGAACAGCACATTTCTAGAGGAATATTCCAAACTGAACTACTTGGACATTCTCATGCGAG
CCTTCATTGATGTGACTGCTGCTGCCGAAAATATCAGGCTGCCAAATGCAGGCACTCAGGTTCGAGTGACTGTGT
TTCCCTCAAAGACTGTAGCTCAGTATTCGGGAGTACCTTGGTGGATCATCCTAGTGGCTATTCTCGCTGGGATCT
TGATGCTTGCTTTATTAGTGTTTATACTATGGAAGTGTGGTTTCTTCAAGAGAAATAAGAAAGATCATTATGATG
CCACATATCACAAGGCTGAGATCCATGCTCAGCCATCTGATAAAGAGAGGCTTACTTCTGATGCATAGTATTGAT
CTACTTCTGTAATTGTGTGGATTCTTTAAACGCTCTAGGTACGATGACAGTGTTCCCCGATACCATGCTGTAAGG
ATCCGGAAAGAAGAGCGAGAGATCAAAGATGAAAAGTATATTGATAACCTTGAAAAAAAACAGTGGATCACAAAG
TGGAACAGAAATGAAAGCTACTCATAGCGGGGGCCTAAAAAAAAAAAAGCTTCACAGTACCCAAACTGCTTTTTC

FIGURE 534B

```
CAACTCAGAAATTCAATTTGGATTTAAAAGCCTGCTCAATCCCTGAGGACTGATTTCAGAGTGACTACACACAGT
ACGAACCTACAGTTTTAACTGTGGATATTGTTACGTAGCCTAAGGCTCCTGTTTTGCACAGCCAAATTTAAAACT
GTTGGAATGGATTTTTCTTTAACTGCCGTAATTTAACTTTCTGGGTTGCCTTTGTTTTTGGCGTGGCTGACTTAC
ATCATGTGTTGGGGAAGGGCCTGCCCAGTTGCACTCAGGTGACATCCTCCAGATAGTGTAGCTGAGGAGGCACCT
ACACTCACCTGCACTAACAGAGTGGCCGTCCTAACCTCGGGCCTGCTGCGCAGACGTCCATCACGTTAGCTGTCC
CACATCACAAGACTATGCCATTGGGGTAGTTGTGTTTCAACGGAAAGTGCTGTCTTAAACTAAATGTGCAATAGA
AGGTGATGTTGCCATCCTACCGTCTTTTCCTGTTTCCTAGCTGTGTGAATACCTGCTCACGTCAAATGCATACAA
GTTTCATTCTCCCTTTCACTAAAAACACACAGGTGCAACAGACTTGAATGCTAGTTATACTTATTTGTATATGGT
ATTTATTTTTCTTTTCTTTACAAACCATTTTGTTATTGACTAACAGGCCAAAGAGTCTCCAGTTTACCCTTCAG
GTTGGTTTAATCAATCAGAATTAGAATTAGAGCATGGGAGGGTCATCACTATGACCTAAATTATTTACTGCAAAA
AGAAAATCTTTATAAATGTACCAGAGAGAGTTGTTTTAATAACTTATCTATAAACTATAACCTCTCCTTCATGAC
AGCCTCCACCCCACAACCCAAAAGGTTTAAGAAATAGAATTATAACTGTAAAGATGTTTATTTCAGGCATTGGAT
ATTTTTACTTTAGAAGCCTGCATAATGTTTCTGGATTTACATACTGTAACATTCAGGAATTCTTGGAGAAGATG
GGTTTATTCACTGAACTCTAGTGCGGTTTACTCACTGCTGCAAATACTGTATATTCAGGACTTGAAAGAAATGGT
GAATGCCTATGGAACTAGTGGATCCAAACTGATCCAGTATAAGACTACTGAATCTGCTACCAAAACAGTTAATCA
GTGAGTCGAGTGTTCTATTTTTGTTTGTTTCCTCCCCTATCTGTATTCCCAAAAATTACTTTGGGGCTAATTT
AACAAGAACTTTAAATTGTGTTTTAATTGTAAAAATGGCAGGGGGTGGAATTATTACTCTATACATTCAACAGAG
ACTGAATAGATATGAAAGCTGATTTTTTTTAATTACCATGCTTCACAATGTTAAGTTATATGGGGAGCAACAGCA
AACAGGTGCTAATTTGTTTTGGATATAGTATAAGCAGTGTCTGTGTTTGAAAGAATAGAACACAGTTTGTAGTG
CCACTGTTGTTTGGGGGGGGCTTTTTTTCTTTTTCCGGAAAATCCTTAAACCTTAAGATACTAAGGACGTTGTT
TTGGTTGTACTTGGAATTCTTAGTCACAAAATATATTTTGTTTACAAAAATTTCTGTAAAACAGGTTATAACAGT
GTTTAAAGTCTCAGTTTCTTGCTTGGGGAACTTGTGTCCCTAATGTGTTAGATTGCTAGATTGCTAAGGAGCTGA
TACTTGACAGTTTTTTAGACCTGTGTTACTAAAAAAAAAGATGAATGTCGGAAAAGGGTGTTGGGAGGGTGGTCAA
CAAAGAAACAAAGATGTTATGGTGTTTAGACTTATGGTTGTTAAAAATGTCATCTCAAGTCAAGTCACTGGTCTG
TTTGCATTTGATACATTTTGTACTAACTAGCATTGTAAATTATTTCATGATTAGAAATTACCTGTGGATATTT
GTATAAAAGTGTGAAATAAATTTTTATAAAAGTGTTCATTGTTTCGTAACACAGCATTGTATATGTGAAGCAAA
CTCTAAAATTATAAATGACAACCTGAATTATCTATTTCATCAAAAAAAAAAAAAAAAAAAA
```

FIGURE 535

```
MAAAGQLCLLYLSAGLLSRLGAAFNLDTREDNVIRKYGDPGSLFGFSLAMHWQLQPEDKRLLLVGAPRGEALPLQ
RANRTGGLYSCDITARGPCTRIEFDNDADPTSESKEDQWMGVTVQSQGPGGKVVTCAHRYEKRQHVNTKQESRDI
FGRCYVLSQNLRIEDDMDGGDWSFCDGRLRGHEKFGSCQQGVAATFTKDFHYIVFGAPGTYNWKGIVRVEQKNNT
FFDMNIFEDGPYEVGGETEHDESLVPVPANSYLGFSLDSGKGIVSKDEITFVSGAPRANHSGAVVLLKRDMKSAH
LLPEHIFDGEGLASSFGYDVAVVDLNKDGWQDIVIGAPQYFDRDGEVGGAVYVYMNQQGRWNNVKPIRLNGTKDS
MFGIAVKNIGDINQDGYPDIAVGAPYDDLGKVFIYHGSANGINTKPTQVLKGISPYFGYSIAGNMDLDRNSYPDV
AVGSLSDSVTIFRSRPVINIQKTITVTPNRIDLRQKTACGAPSGICLQVKSCFEYTANPAGYNPSISIVGTLEAE
KERRKSGLSSRVQFRNQGSEPKYTQELTLKRQKQKVCMEETLWLQDNIRDKLRPIPITASVEIQEPSSRRRVNSL
PEVLPILNSDEPKTAHIDVHFLKEGCGDDNVCNSNLKLEYKFCTREGNQDKFSYLPIQKGVPELVLKDQKDIALE
ITVTNSPSNPRNPTKDGDDAHEAKLIATFPDTLTYSAYRELRAFPEKQLSCVANQNGSQADCELGNPFKRNSNVT
FYLVLSTTEVTFDTPYLDINLKLETTSNQDNLAPITAKAKVVIELLLSVSGVAKPSQVYFGGTVVGEQAMKSEDE
VGSLIEYEFRVINLGKPLTNLGTATLNIQWPKEISNGKWLLYLVKVESKGLEKVTCEPQKEINSLNLTESHNSRK
KREITEKQIDDNRKFSLFAERKYQTLNCSVNVNCVNIRCPLRGLDSKASLILRSRLWNSTFLEEYSKLNYLDILM
RAFIDVTAAAENIRLPNAGTQVRVTVFPSKTVAQYSGVPWWIILVAILAGILMLALLVFILWKCGFFKRNKKDHY
DATYHKAEIHAQPSDKERLTSDA
```

FIGURE 536

GTGACCTTGGGCAAGTTGCTTAACCTTTAAACATTGATTACCCCATCTGTACATTGTGCATAATAGTAATATTTA
CTCCACAGTGAGGAACCAATGAGATTGCGTGTATAACATCTGCTGGCTCACTGAGTGACACAAAGGAAGTGCTCC
ACGAGTGTTGATTACTCTCTGAGTACTGCTTTTCTGATCTAGCAATCTGGTTCTCTGGGGTTGGGAAAGTCAGA
ATAAGATATTTCAGATACCACCAGAGTTACCATTAGCATTTTGGTATGTTTTGTTTCTCCATCTGTATTTTA
ATCATAGTTGTAATTATGATTATATATATGTAAATATATATGTCTGCGTATGTGTGTTTGTGTATCCGTATACA
CACACCTATACAAATGATGTTTTCACATTATGTCATAAGCATTTCTCTGCTACTGTATGATTTTCATACTCACTA
TTTGTAGTCACTACAAAGTGTTAGGTTGGAGAAGTTTTGCTGTTGGAGCCTGAGGGTAAGAAAATGTTAGTCTCT
TCAAAATAGAATCAGTGAGTACTAGAATAGGTAGTGATTTTGAAATGTCAGGAAGAGATTAATTATTATTCTTTT
TAAAGTATATTCTCTTTTTGTAACCTTAGTCATTTATTCCTGAATTTGGGGAGAACCCACCAGAAGCCTGGCGGT
CCACTGTGGATGGGGCAGTAAACAGGCTGGCACGGTGTCTCCGGAAGCTTACGTTCTGAGTTTAGTGGGTAGAGG
TAAAGAAAGAAGATTTAAAAAAAAAAAAAAAGCGGTGCTATGTAGATATTAATATAGGGTGATGAGACTTTCCTG
TTAAAAACCAGCTGCTAATTCCTGAGTAGTTCCTGTGTTCTGAGGACTGTGCATTACACCCTTTCATTCTCACAG
TCACCCTGCATGGTAAGTAGGCCTTACCTACTTATAGCGCCCTTCCAGTGGTGAAAGGGAGGCTTCTTGGAGGGT
AAGTAACTTGCCTGAGGTCAC

FIGURE 537

VTLGKLLNL

FIGURE 538

```
GTAGATGTCTAGTTATTCCTCATGTAAAACACAACATTTCAACCCTGAGTACTATAAACTTTATTATGCTTCTAG
GTTACTTTTTCTCTTTAAGCAATTATTCCTACATTCCTAAGTGTTCACCAGTGGAACAGATAAGAGATAGAAGTA
GTTAGAAATTGAGATAATTGGGTTGACCTGTCATTGTTGCCAGGATAATTACTGGAAGATTAAGCCTATCTGTTA
GACATTTTGACCATGTTTATAATTGTTGTTAGTATTCTGTCAGAATGTATCTGTTTTCTAGTTATTAAAAGAAGC
AACAGAATCGAGGCACAAATATGAAGAAATGAAACAAGAAGAAGCACAACTGAAAGAGCAGCTTTTCCTTTATAT
GGATAAGTTTGAAGAATTCCAGACTACCATGGCAAAAACCAATGAACTTTTTACAGCCTTCAAGCAGGAAACGGA
AAAGCTGACAAAGAAAATTAAAAAACTGGAAAAAGAAATGGTAATATGGTATACCAAATGGGAAAATAATAATAC
AACACTTCTGCAAATGGCTGAAGAGAAAACTATTCGTGATAAAAATTATAAGGTCTTTCAAATAAAATTGGAGCG
GTTAGAGAAGCTGTACAAGGCTCTTCAAATAGAAAGGAATGAACTCAGTGAGAAACTGGGAATTCTGAAAGGGCA
GGTCTCTGTGAAAGTAGCAGATGTAGATTTAGCAGTGCCTGTGACGCATTCCTGTGCTGACCTGGATTCTTCCAA
TATGCTGAACACTTCCTCTAAAAGAGCCCCAGGAGTCCATCTGGAGGCTGACCCCAAAGGAATGAATGAAGTAAA
ATGCTACTCAAAAGCCCTCTCCACAGGATCTCCTCTAGGCATTGATTAAGATTAAGTGTGATCATTGTACTGATG
GATATATTTTGTGTACATGTTTCTCTTTTAGTTGTAACTATTGATTTTGTAATGAAAATTTCCTCTCCTTTTTCT
ACCATATCTCTGTTTTTTAGAACTACTCAACTGTGTGGTAACAGAAAGCTTCTTACCAATTTCCCCAACTATGT
TGCACATCAGCCTCATTTTCCCCCTTTATTGGAATGCATGTTTTCATTGCCTTCTCCTTTCAAAGTGTACGTTTG
TGTGTTCATCACCTTAAATTATCTTAATTTGAGACTTTTTATAATGGTTTCGTAATGTGAAATCAAATACTAAT
TTAAACTCTGGAGCCCATAATATCTACATAAAAGAAAATATAAACTGACTAATATTGTCAAGTCATTTAAATGAT
AAGTAAAACTTCAATGGATTAAGAAACAAGCATGGCATATTTGATTCAGATCAGTTTTTGACAATATTTGTATG
ACTTTCCAAATTGATGTGACTGTAAACTTTGAATTCCTCAAAATTGACAGAATATATATATATATATATATAT
ATATATATATATATATATGTATGTACACACACAGAGAGATCATTTAAATGTAAATGATGTTAAGAAAAACC
AAAACAGTAGCATATGCAGGCAAGTCATTGGACCAATAGGCTTAATATTTATGAAACTGACAATTGTTCTGCTTT
AGTTTCAGGTTACAATTATGTTTAAAGAAAAAAAAATCAGTATCTAGATCTCTGCACTTGGCATGGAAAATTTTG
AACTATTTATTCCTTAATTTTCTTTTATTTCAGTTTCTCATAGAGCTAAATGGTTTTACATATATTCTCTTGTCA
GATTTGTGGTCTAATAGAGGTAGAAAATGGAAATTTTCCCAGTACTTAGAAATATGGTACTTAGGAAGAAGTCTA
GGATGTGAATTACATATACACTTCCCCTAGTGACTATGATAATCAAGGGGGCAGATAGCAGAGGAAAATAAGTTA
ACATGAAATTTGACAAATTTTATTACTTTGCCAAAATTAGCAAAACAAAATACTCACCTTCCCCTGCTCACCCC
CCAACTTTTTATAAATATTCAATTCAGCTACAAAACAAAATACTGGACCCACTTCTTTCAGAAGAGATGAAGATA
CCTTATATGCCCTAAAGTTAATACCAGCAGTCATATTTATCAGATGTAAATCTGGATGTAAGCTCTTAATGTTA
TACTAAGGCAGTTTCTTAGGCTGTGACACTTCTTTGTGGTACTTGTTTTGTGTGAAAGGTAAATTTTGGGGAGAA
AACAATGTGAAAAACAGAACTTGTTCTGTTGTTTTGGCATACTGTTTATGTTAGATACACTGTGTTACAATACA
ATATTACGAAGATCTGCATTGTATTTTGGAATTTGGTTTCCTTTCAGAATTATTGCTCTGGCTAGCATTGGAAAC
AACAACAACAACAAAACCCAAAGGAACCCTTTGCAGAAGATTCCCTTGTAAATGGCCCTGTGGCATGCCCAGTAT
CTGCAATGTTCTAGAATAGAAGTTGGCAAACCTCTCTGTTTGCCAAGCCTGCAGAGTTGAACATGTCCATAAATG
TATACAATCTGACCCTGTTTTTGGCCCTGTTTCTGGACACTGTAGCTGACCAAGAAAATGTTTAAATGTTGCGA
TCAATTAAATTTTTTTGTTGTA
```

FIGURE 539

MKQEEAQLKEQLFLYMDKFEEFQTTMAKTNELFTAFKQETEKLTKKIKKLEKEMVIWYTKWENNNTTLLQMAEEK
TIRDKNYKVFQIKLERLEKLYKALQIERNELSEKLGILKGQVSVKVADVDLAVPVTHSCADLDSSNMLNTSSKRA
PGVHLEADPKGMNEVKCYSKALSTGSPLGID

FIGURE 540

```
ACACTCGCTTCTGGAACGTCTGAGGTTATCAATAAGCTCCTAGTCCAGACGCCATGGGTCATTTCACAGAGGAGG
ACAAGGCTACTATCACAAGCCTGTGGGGCAAGGTGAATGTGGAAGATGCTGGAGGAGAAACCCTGGGAAGGCTCC
TGGTTGTCTACCCATGGACCCAGAGGTTCTTTGACAGCTTTGGCAACCTGTCCTCTGCCTCTGCCATCATGGGCA
ACCCCAAAGTCAAGGCACATGGCAAGAAGGTGCTGACTTCCTTGGGAGATGCCATAAAGCACCTGGATGATCTCA
AGGGCACCTTTGCCCAGCTGAGTGAACTGCACTGTGACAAGCTGCATGTGGATCCTGAGAACTTCAAGCTCCTGG
GAAATGTGCTGGTGACCGTTTTGGCAATCCATTTCGGCAAAGAATTCACCCCTGAGGTGCAGGCTTCCTGGCAGA
AGATGGTGACTGGAGTGGCCAGTGCCCTGTCCTCCAGATACCACTGAGCTCACTGCCCATGATGCAGAGCTTTCA
AGGATAGGCTTTATTCTGCAAGCAATACAAATAATAAATCTATTCTGCTAAGAGATCAC
```

FIGURE 541

MGHFTEEDKATITSLWGKVNVEDAGGETLGRLLVVYPWTQRFFDSFGNLSSASAIMGNPKVKAHGKKVLTSLGDA
IKHLDDLKGTFAQLSELHCDKLHVDPENFKLLGNVLVTVLAIHFGKEFTPEVQASWQKMVTGVASALSSRYH

FIGURE 542

```
GGGGGGCACAGGGGAGACTAAAAAGGCCAGGGAAGTTGGCCTGCCGGAAGTTCCCAGGGAGAAGGCAGCGCGTTG
TACCCGAGTTACCTGTAGTCAACCACAGTCTGAAAATATTAAGGTATTTTAAGACAGAAAGAGAGAGAGGAGAGA
AACCGCATTCACAAAAAAGAAATCCTCTTTTTAGAACATCTCTTGGTGGTACCATCAGAAATGTCTTCCTTAAGT
GGAAAAGTCCAAACCGTTTTGGGCCTTGTAGAGCCAAGCAAACTGGGCCGTACCCTGACCCATGAACACCTGGCC
ATGACCTTTGACTGCTGTTACTGTCCACCTCCCCCGTGCCAGGAAGCTATTTCCAAAGAACCTATCGTGATGAAA
AATTTATATTGGATTCAGAAAAACGCCTATTCCCATAAAGAAAACCTTCAATTAAATCAGGAGACAGAAGCCATA
AAGGAAGAACTGTTGTATTTTAAAGCTAATGGTGGAGGGGCTTTGGTGGAAAACACAACCACTGGGATTAGCCGA
GACACACAGACGTTGAAGAGGCTTGCAGAAGAGACTGGCGTCCATATCATATCTGGAGCCGGGTTTTATGTGGAT
GCAACTCACTCCTCAGAGACCAGGGCCATGTCAGTGGAGCAGCTTACCGATGTCCTTATGAATGAAATTCTCCAT
GGAGCTGATGGAACCAGTATCAAGTGTGGCATTATTGGAGAAATTGGTTGCTCCTGGCCTTTGACTGAGAGTGAA
AGAAAGGTTCTCCAGGCCACAGCTCATGCCCAGGCTCAGCTTGGTTGTCCTGTTATTATCCATCCTGGACGGAGC
TCCAGGGCACCATTTCAGATTATCCGAATATTGCAAGAAGCAGGCGCAGACATCTCCAAAACAGTCATGTCACAC
CTGGATAGGACTATTCTTGATAAGAAAGAGCTCTTGGAGTTTGCTCAACTTGGCTGCTACTTGGAATATGATCTC
TTTGGTACTGAACTACTTCATTACCAACTCGGCCCAGATATTGACATGCCTGATGATAACAAAAGAATTAGAAGG
GTGCGTCTCCTGGTGGAAGAGGGCTGTGAAGATCGAATTCTGGTAGCACATGACATACATACGAAAACCCGGCTG
ATGAAATATGGAGGTCACGGCTATTCTCATATACTCACCAATGTTGTTCCTAAAATGTTGCTGAGAGGCATAACT
GAGAATGTGCTTGATAAGATTCTAATAGAGAACCCTAAGCAATGGCTAACTTTCAAATAGGATGGTTGCTTATGA
ATTCACACCTTGAGTATAAAACTTGCAGAGAACATTCAGCGATTTCCAGTCCACTGTGAGATATTAATCAGTTAC
CTAGGACTAATGACAGATCATTTCCTTCTGATGAGAACTAGGAGGGTTTGCCTTCTCTGAGACCAGCTATTACAA
CTGTGCCTCTAGGGAGTTACTCAGCCTAATTGAGCCCTATTATTTTAACTTAACAAAATAAATACAGAAGTACCT
ATTTCTAAACAATGATTTAAAGTCTATATCCCCTAAGCGGAGTTGTTGTTTTCTCCCTAATCTATCAGCTGCAC
TACTTGAGAAAATTTAAAGTGTTTCTAGTTAAATTATTTCCTTCTTGAGCGATCTAATGTTTCTTGTAATATTGA
TGATCCTACTAATTATCCTGCTGTTCTTTAATTAATGCTTAATGAATAATATGGCACTGTAAAATAGCTTCTGCA
ACAAGGGAAGTTAAATTTTGAGACTTTTTCCCCAAAGGATACTGACTGTAATACAATTACCAATTCACAATGAT
AAAAATATTTTGAAAGGTTAATTTTATACTGTCCACCTATCTATATATTCTTCTACTGAAATGATTTTGATATCT
TTGGCTTTCCGGTATCTATTTTTGCCATACATTTTGCTGTTTTGCAAAGTTTGTATAAGAACACATAACACTACT
GAATTATAAAAATTCAATCATAAAAGTCAAAATATATTACATAATATAGTTTAATGAATCATTACATTTATAATA
ACAAAGGCCACAATTTAATTAATTGGTAAGATATAATGCAAAAAAAAAAGAGAAATGTTTGCCTTATGTATATT
CCCTTTATTTCCTTTACCTTTTGTTTTTCCTTGGACCTAAACAGAGAAAATAATGCTTATGTATCTGAAGAAAAG
GTCAGATCTATTGGAAATGACAGCCCGATACTTGAGCCTCCTCTTAAAAGGTATCCAGCCCTGATATTTGTGT
AAATAAAATGTTTTTAAAACCTGTTAGTTAAAACACTTAGGTGATGGGCACTGCTGCTTATAAATTCATCTTTTG
GTTGAATCCTCACTATGCTATTTGGTACCTAAAAATATTCTCCAAACCCTTGCTGCCAGTTCCTCTTTGATAAAT
ATATAGTTAATTCGAAATAAAATCCATTGCAATTCATTTATGAGTTATCTTACATATCACAAAGACCAATTAGAA
TTAGTCATTATTCTTGATGAAGAGTCTGTTTTAATCATAAAAATCATGACAGTTACTCAGACCCAGGCATTTCA
ACAGAGCTAACACCACCTTCAGATAGGCACACCATGCATAACTCTTGGGAAGTTGAGCTTTGCTAAATAAAGAT
ATTTCTGCTGATCAAAGATGATCAAGCTTTCTGTGTATTGGAACAGAAAGTAACAAAGAGGAATGAGCCAGGAGA
ACAAACTAATTCCAAAAAAAAAAAAAAAAAAAAAAAAAAAAAA
```

FIGURE 543

```
MSSLSGKVQTVLGLVEPSKLGRTLTHEHLAMTFDCCYCPPPPCQEAISKEPIVMKNLYWIQKNAYSHKENLQLNQ
ETEAIKEELLYFKANGGGALVENTTTGISRDTQTLKRLAEETGVHIISGAGFYVDATHSSETRAMSVEQLTDVLM
NEILHGADGTSIKCGIIGEIGCSWPLTESERKVLQATAHAQAQLGCPVIIHPGRSSRAPFQIIRILQEAGADISK
TVMSHLDRTILDKKELLEFAQLGCYLEYDLFGTELLHYQLGPDIDMPDDNKRIRRVRLLVEEGCEDRILVAHDIH
TKTRLMKYGGHGYSHILTNVVPKMLLRGITENVLDKILIENPKQWLTFK
```

FIGURE 544

ATGTGGCTCTTCTTCGGGATCACTGGATTGCTGACGGCAGCCCTCTCAGGTCATCCATCTCCAGCCCCACCTGAC
CAGCTCAACACCAGCAGTGCAGAGAGTGAGCTCTGGGAGCCAGGGGAGCGGCTTCCGGTCCGTCTGACAAACGGG
AGCAGCAGCTGCAGCGGGACGGTGGAGGTGCGGCTCGAGGCGTCCTGGGAGCCCGCGTGCGGGGCGCTCTGGGAC
AGCCGCGCCGCCGAGGCCGTGTGCCGAGCACTGGGCTGCGGCGGGCGGAGGCCGCCTCTCAGCTCGCCCCGCCG
ACCCCTGAGCTGCCGCCCCGCCTGCAGCCGGGAACACCAGCGTAGCAGCTAATGCCACTCTGGCCGGGGCGCCC
GCCCTCCTGTGCAGCGGCGCCGAGTGGCGGCTCTGCGAGGTGGTGGAGCACGCGTGCCGCAGCGACGGGAGGCGG
GCCCGTGTCACCTGTGCAGAGAACCGCGCGCTGCGCCTGGTGGACGGTGGCGGCGCCTGCGCCGGCCGCGTGGAG
ATGCTGGAGCATGGCGAGTGGGGATCAGTGTGCGATGACACTTGGGACCTGGAGGACGCCCACGTGGTGTGCAGG
CAACTGGGCTGCGGCTGGGCAGTCCAGGCCCTGCCCGGCTTGCACTTCACGCCCGGCCGCGGGCCTATCCACCGG
GACCAGGTGAACTGCTCGGGGGCCGAAGCTTACCTGTGGGACTGCCCGGGGCTGCCAGGACAGCACTACTGCGGC
CACAAAGAGGACGCGGGCGTGGTGTGCTCAGAGCACCAGTCCTGGCGCCTGACAGGGGGCGCTGACCGCTGCGAG
GGGCAGGTGGAGGTACACTTCCGAGGGGTCTGGAACACAGTGTGTGACAGTGAGTGGTACCCATCGGAGGCCAAG
GTGCTCTGCCAGTCCTTGGGCTGTGGAACTGCGGTTGAGAGGCCCAAGGGGCTGCCCCACTCCTTGTCCGGCAGG
ATGTACTACTCATGCAATGGGGAGGAGCTCACCCTCTCCAACTGCTCCTGGCGGTTCAACAACTCCAACCTCTGC
AGCCAGTCGCTGGCAGCCAGGGTCCTCTGCTCAGCTTCCCGGAGTTTGCACAATCTGTCCACTCCCGAAGTCCCT
GCAAGTGTTCAGACAGTCACTATAGAATCTTCTGTGACAGTGAAAATAGAGAACAAGGAATCTCGGGAGCTAATG
CTCCTCATCCCCTCCATCGTTCTGGGAATTCTCCTCCTTGGCTCCCTCATCTTCATAGCCTTCATCCTCTTGAGA
ATTAAAGGAAAATATGCCCTCCCCGTAATGGTGAACCACCAGCACCTACCCACCACCATCCCGGCAGGGAGCAAT
AGCTATCAACCGGTCCCCATCACCATCCCCAAAGAAGTTTTCATGCTGCCCATCCAGGTCCAGGCCCCGCCCCCT
GAGGACTCAGACTCTGGCTCGGACTCAGACTATGAGCACTATGACTTCAGCGCCCAGCCTCCTGTGGCCCTGACC
ACCTTCTACAATTCCCAGCGGCATCGGGTCACAGATGAGGAGGTCCAGCAAAGCAGGTTCCAGATGCCACCCTTG
GAGGAAGGACTTGAAGAGTTGCATGCCTCCCACATCCCAACTGCCAACCCTGGACACTGCATTACAGACCCGCCA
TCCCTGGGCCCTCAGTATCACCCGAGGAGCAACAGTGAGTCGAGCACCTCTTCGGGGGAGGATTACTGCAATAGT
CCCAAAAGCAAGCTGCCTCCATGGAACCCCCAGGTGTTTCTTCAGAGAGGAGTTCCTTCCTGGAGCAGCCCCA
AACTTGGAGCTGGCCGGCACCCAGCCAGCCTTTTCAGCAGGGCCCCCGGCTGATGACAGCTCCAGCACCTCATCC
GGGGAGTGGTACCAGAACTTCCAGCCACCACCCCAGCCCCCTTCGGAGGAGCAGTTTGGCTGTCCAGGGTCCCCC
AGCCCTCAGCCTGACTCCACCGACAACGATGACTACGATGACATCAGCGCAGCCTAGGCC

FIGURE 545

MWLFFGITGLLTAALSGHPSPAPPDQLNTSSAESELWEPGERLPVRLTNGSSSCSGTVEVRLEASWEPACGALWD
SRAAEAVCRALGCGGAEAASQLAPPTPELPPPPAAGNTSVAANATLAGAPALLCSGAEWRLCEVVEHACRSDGRR
ARVTCAENRALRLVDGGGACAGRVEMLEHGEWGSVCDDTWDLEDAHVVCRQLGCGWAVQALPGLHFTPGRGPIHR
DQVNCSGAEAYLWDCPGLPGQHYCGHKEDAGVVCSEHQSWRLTGGADRCEGQVEVHFRGVWNTVCDSEWYPSEAK
VLCQSLGCGTAVERPKGLPHSLSGRMYYSCNGEELTLSNCSWRFNNSNLCSQSLAARVLCSASRSLHNLSTPEVP
ASVQTVTIESSVTVKIENKESRELMLLIPSIVLGILLLGSLIFIAFILLRIKGKYALPVMVNHQHLPTTIPAGSN
SYQPVPITIPKEVFMLPIQVQAPPPEDSDSGSDSDYEHYDFSAQPPVALTTFYNSQRHRVTDEEVQQSRFQMPPL
EEGLEELHASHIPTANPGHCITDPPSLGPQYHPRSNSESSTSSGEDYCNSPKSKLPPWNPQVFSSERSSFLEQPP
NLELAGTQPAFSAGPPADDSSSTSSGEWYQNFQPPPQPPSEEQFGCPGSPSPQPDSTDNDDYDDISAA

FIGURE 546

```
TTCCGGCGGCGGCGGCGGCGGGCTGCGAGGGCGGCGGGGGCCCGAACCCGGGGCCGGCGGGCGGCAGGAGGC
CTCCTCGGGCCGCGGGGGGCGCCACCGCCGGCTCCCGGCAGCCCAGCGTGGAGACCCTGGACAGTCCCACAGGAT
CACATGTTAATGGTGTAAACAGCTTATAGCTGCTACAATTTCTAGTCAGATTTCAGGTTCAGTGACATCAGAAA
ATGTGTCCAGAGATTACAAGGCTCTAAGGGATGGAAATAAGCTGGCACAGATGGAAGAGGCTCCACTTTTCCCAG
GAGAATCAATTAAAGCCATTGTGAAAGATGTCATGTATATCTGCCCATTTATGGGAGCAGTGAGTGGAACCCTGA
CAGTGACGGACTTTAAGCTGTACTTCAAAAATGTCGAGAGGGACCCGCATTTTATCCTTGATGTTCCCCTTGGAG
TGATCAGCAGAGTGGAGAAGATTGGAGCACAGAGCCATGGAGACAATTCCTGTGGTATAGAGATAGTGTGCAAGG
ATATGAGGAACTTGCGGCTTGCTTATAAACAGGAAGAACAGAGTAAACTAGGGATATTTGAAAACCTCAACAAAC
ATGCATTTCCTCTTTCTAACGGACAGGCACTATTTGCATTCAGCTATAAAGAAAAATTTCCAATTAATGGCTGGA
AAGTTTATGATCCAGTATCTGAATATAAGAGACAGGGCTTGCCAAATGAGAGTTGGAAAATATCCAAAATAAACA
GTAATTATGAGTTCTGTGACACCTACCCTGCCATCATTGTTGTGCCAACTAGTGTAAAAGATGATGACCTTTCAA
AAGTGGCAGCTTTTCGAGCAAAAGGCAGAGTCCCTGTGTTGTCATGGATTCATCCGGAAAGTCAAGCAACGATTA
CCCGTTGCAGCCAGCCACTTGTGGGTCCCAATGATAAGCGCTGCAAAGAGGATGAAAAATACTTGCAAACAATAA
TGGATGCTAACGCACAGTCACACAAGCTTATCATCTTTGATGCTCGACAAAACAGTGTCGCTGATACCAACAAGA
CAAAGGGTGGAGGATATGAAAGTGAAAGTGCTTACCCAAATGCAGAACTTGTGTTCTTGGAGATCCACAACATTC
ATGTCATGCGAGAGTCACTACGCAAATTAAAAGAGATTGTGTACCCTTCGATCGATGAGGCGCGGTGGCTCTCCA
ATGTGGATGGGACGCATTGGCTGGAATATATAAGGATGCTGCTTGCTGGGGCAGTAAGAATTGCTGATAAAATAG
AATCTGGGAAAACATCTGTGGTGGTGCATTGCAGCGACGGTTGGGACCGAACAGCCCAGCTCACATCTCTGGCTA
TGCTAATGTTGGACAGTTACTACAGGACCATTAAAGGATTTGAAACTCTCGTAGAAAAGGAGTGGATAAGCTTTG
GACACAGGTTTGCACTGCGAGTGGGCCATGGTAATGACAACCATGCGGATGCTGACCGATCTCCCATATTTCTGC
AGTTTGTTGATTGTGTTTGGCAAATGACAAGGCAGTTTCCTTCAGCATTCGAGTTTAATGAGCTATTCTTGATTA
CAATTTTGGATCACCTTTATAGCTGTCTTTTTGGGACCCTTTTGTGCAACTGTGAACAGCAGCGATTCAAAGAGG
ATGTATATACAAAGACGATATCTTTATGGTCGTATATCAATAGCCAGCTAGACGAGTTTTCTAATCCCTTCTTTG
TGAATTATGAAAACCACGTGTTATATCCTGTTGCTAGTCTGAGTCATTTGGAATTGTGGGTAAATTATTATGTAC
GATGGAATCCACGGATGAGACCTCAGATGCCCATTCACCAGAATCTCAAGGAGCTGCTGGCCGTCAGGGCGGAGC
TGCAGAAGCGTGTGGAGGGCCTACAGCGGGAGGTGGCCACGCGCGCCGTCTCATCCTCATCTGAGCGGGGCTCCT
CGCCCTCCCACTCCGCCACCTCCGTCCACACCTCGGTCTGATGGGCGAGAAATATGTAATCCCCTGGCTGACTAG
GACTGTTAAACATAGTGTGGACTGGATGATGCCTTCGACAAACCAGAGAAGCCAAGTTGGGGGGAGCTGGTGCCT
GGAGTGGGCCCTGTGCACCTCACCTGGCGGAGGCTGGGGGGGCTCTGTCAGCAGGACCCTAGAGGAGACTCTCAT
TCGATTTTAAAGAAGCACAACGGGTCATTTTCCTTGTATGTTCCTAGCGCAGAACTGTTTCTAAAACAACTTGA
AGTATAGTTTTGTTATCTAAGCAATTTTTGTTTTAAGTAAGTAAGTGTACTAGAATGCGAAGCCGTTATGGTTCA
GGTTTTTAAAAACTGGTACAGTATTGTATTTGTCTCATCTGTTGCACTGTATTTCAATCATCTGTAATTAAAATG
ATCATATGTTTGCTCCCTGGTCTTTTTAAGTAAGTAAGTAAGTATCTTAGTAGATTTTTCCTTTGAGGAAAATC
GGTAATAAAATAACATGGATTGAATGTTTACTGTGCGTCAAGCACAGTTAATATATGATGATGTAAAGTAACTAA
CTTTATGTGATTTAATTCATTCAGTAAATTGT
```

FIGURE 547

PAAAAAAGCEGGGGPNPGPAGGRRPPRAAGGATAGSRQPSVETLDSPTGSHVEWCKQLIAATISSQISGSVTSEN
VSRDYKALRDGNKLAQMEEAPLFPGESIKAIVKDVMYICPFMGAVSGTLTVTDFKLYFKNVERDPHFILDVPLGV
ISRVEKIGAQSHGDNSCGIEIVCKDMRNLRLAYKQEEQSKLGIFENLNKHAFPLSNGQALFAFSYKEKFPINGWK
VYDPVSEYKRQGLPNESWKISKINSNYEFCDTYPAIIVVPTSVKDDDLSKVAAFRAKGRVPVLSWIHPESQATIT
RCSQPLVGPNDKRCKEDEKYLQTIMDANAQSHKLIIFDARQNSVADTNKTKGGGYESESAYPNAELVFLEIHNIH
VMRESLRKLKEIVYPSIDEARWLSNVDGTHWLEYIRMLLAGAVRIADKIESGKTSVVVHCSDGWDRTAQLTSLAM
LMLDSYYRTIKGFETLVEKEWISFGHRFALRVGHGNDNHADADRSPIFLQFVDCVWQMTRQFPSAFEFNELFLIT
ILDHLYSCLFGTLLCNCEQQRFKEDVYTKTISLWSYINSQLDEFSNPFFVNYENHVLYPVASLSHLELWVNYYVR
WNPRMRPQMPIHQNLKELLAVRAELQKRVEGLQREVATRAVSSSSERGSSPSHSATSVHTSV

FIGURE 548

ATTTCATGTTATACTTAATAAAACAAAACATACCTGTATACACACACATTCACTCACATTGAAGATGCAAGATGA
AGAAAGATACATGACATTGAATGTACAGTCAAAGAAAAGGAGTTCTGCCCAAACATCTCAACTTACATTTAAAGA
TTATTCAGTGACGTTGCACTGGTATAAAATCTTACTGGGAATATCTGGAACCGTGAATGGTATTCTCACTTTGAC
TTTGATCTCCTTGATCCTGTTGGTTTCTCAGGGAGTATTGCTAAAATGCCAAAAAGGAAGTTGTTCAAATGCCAC
TCAGTATGAGGACACTGGAGATCTAAAAGTGAATAATGGCACAAGAAGAAATATAAGTAATAAGGACCTTTGTGC
TTCGAGATCTGCAGACCAGACAGTACTATGCCAATCAGAATGGCTCAAATACCAAGGGAAGTGTTATTGGTTCTC
TAATGAGATGAAAAGCTGGAGTGACAGTTATGTGTATTGTTTGGAAAGAAAATCTCATCTACTAATCATACATGA
CCAACTTGAAATGGCTTTTATACAGAAAAACCTAAGACAATTAAACTACGTATGGATTGGGCTTAACTTTACCTC
CTTGAAAATGACATGGACTTGGGTGGATGGTTCTCCAATAGATTCAAAGATATTCTTCATAAAGGGACCAGCTAA
AGAAACAGCTGTGCTGCCATTAAGGAAAGCAAAATTTTCTCTGAAACCTGCAGCAGTGTTTTCAAATGGATTTG
TCAGTATTAGAGTTTGACAAAATTCACAGTGAAATAATCAATGATCACTATTTTTGGCCTATTAGTTTCTAATAT
TAATCTCCAGGTGTAAGATTTTAAAGTGCAATTAAATGCCAAAATCTCTTCTCCCTTCTCCCTCCATCATCGACA
CTGGTCTAGCCTCAGAGTAACCCCTGTTAACAAACTAAAATGTACACTTCAAAATTTTTACGTGATAGTATAAAC
CAATGTGACTTCATGTGATCATATCCAGGATTTTTATTCGTCGCTTATTTTATGCCAAATGTGATCAAATTATGC
CTGTTTTCTGTATCTTGCGTTTTAAATTCTTAATAAGGTCCTAAACAAAATTTCTTATATTTCTAATGGTTGAA
TTATAATGTGGGTTTATACATTTTTTACCCTTTTGTCAAAGAGAATTAACTTTGTTTCCAGGCTTTTGCTACTCT
TCACTCAGCTACAATAAACATCCTGAATGTTTTCTTAAAAAA

FIGURE 549

MQDEERYMTLNVQSKKRSSAQTSQLTFKDYSVTLHWYKILLGISGTVNGILTLTLISLILLVSQGVLLKCQKGSC
SNATQYEDTGDLKVNNGTRRNISNKDLCASRSADQTVLCQSEWLKYQGKCYWFSNEMKSWSDSYVYCLERKSHLL
IIHDQLEMAFIQKNLRQLNYVWIGLNFTSLKMTWTWVDGSPIDSKIFFIKGPAKENSCAAIKESKIFSETCSSVF
KWICQY

FIGURE 550A

```
CAAGGATTTGCTAGCTGATAAAGAACTGTGGGCTCGACTTGAAGAACTAGAGAGACAGGAAGAATTGCTGGGTGA
ACTTGATAGTAAGCCTGATACTGTGATTGCAAATGGAGAAGATACCACATCTTCTGAAGAGGTATACTTCTTGTG
ATAAGGATGTTGCAAGTTCAGAACCATTCAGTGGTCAAGTGAATAGTCAGTTGAACTGTTCAGTGAATGGTTCCA
GATCTTACCACAGNNNNNNNNNNNNNNNNNNNNNNNNNNNNNNNNNNNNNNNNNNNNNATTGACGACGATGATGGTGATA
ACGACCATGAGGCTTTAGGGGTTGGAGATAATTCTATACCAACAATATATTTTTCACATACTGTTGAGCCTAAGA
GGGTCCGAATAAATACTGGAAAGAATACCACTTTAAAATTCAGTGAAAAGAAAGAAGAAGCCAAACGTAAACGAA
AGAACAGCACTGGCAGTGGCCACTCTGCCCAGGAGCTGCCGACCATCAGGACGCCTGCAGACATTTACAGAGCCT
TTGTTGATGTTGTGAATGGAGAATATGTCCCTCGCAAATCCATCCTGAAGTCTCGAAGTAGAGAGAATAGTGTGT
GTAGCGACACTAGTGAAAGCAGTGCTGCTGAATTTGATGATAGGCGGGGAGTTTTGAGGAGTATCAGCTGCGAAG
AAGCCACTTGCAGTGACACCAGTGAGAGCATTTTGGAAGAGGAACCACAAGAAAATCAAAAGAAACTTTTGCCCT
TATCAGTAACACCTGAGGTGTGTGTGTGTATCTTTTAATTCTTTATTTCATATAGTATCTTTGACCAGTTTTAGC
TATTTAATCTGAAAAGTCATAAGATTAAATTAATTCTAGGTTTTATACTTTCTTGGTACTAATTAATAAAAAATT
AATAGTCACAAACAGTACAAATATTGTGATAATCAAATAGTTTATTTTTGATAAACACATTACTTGTCTTAACG
TTCTATTTCAGCAAAATGGGAAATTTAAAATGTCTTACTTGGCATTATGTATTACATTTGTAGCTAGGAAATTAT
TTCGCAGTTTATTTAAATAAATTACCAGTAGGTCATTTCTGATAGTGTAAGGAGCAGATTACATTATTCTCTT
TTAAATACCTTGGCTAAGTTAAAGAAAAATAATGCATGCATAGCAGATAATTACCTAAAGTCTAATATTTTACCT
TGTACCAGTGAAACTTAACTCTTGGGGATTATGGAATTGTTTTATAATCTGATGAAAGCTGTAGACCCTGTCCA
TAGAAAAAATAGTGCACACTCAATACACTTTCACCCACCACACTTCTTACAGTTTTTGGTGGTGGTGCAGGGGAG
GTTAGGAAATCCCCAAATAAGGATGTCTGTGAAATATAAGGCTATTGATTTCTTCATTCTTGTGTTTTGGTGCGT
ATTTGAAGTTTTCAATTTAAAAAGTATTTAGGAAGATTGGGGAACCCATGCCTGGATCAAACCAGTGTACACATT
TGTATATACAATAAGATACATGCATATATATAACCTTATCTAAAATTCCATTGCTTTACTAAATGGTATTATA
CTCAGTGTATTAAATGGTAATTGGGGATGGAGATTGGTAGCATTTAGGGACAGTACATATGACTAGAATGTTTC
TTCCCCTCTTCTTAGTATAATGATCTTAGGTGACCTGGAAAGTATCTTACCTTATTTGATAGTCTTCCATACTGT
TAGAAAACAGGTAATGGATGTTATCAGGTAATTGCTGATAAATGTTTGAAAATTAGTTTTTTGTAAGGACTTAGT
GTATCATGGTACAGCTAGAGTGTGGAACCTATTTTTATTTCACCCTTAGTAGCTTTGCATTTTGTATGGAAATG
TTTAATAGTAGTTGCTATACATTTTTTAACATCAAAGAAATAGTTCATGATTATGGTAAGTACTTTGGAAGATAT
CCTTTTCAGTATCTTTTAAATGCTAAAATACCTCTTTTCAAAGGCATTTAAATAGAAGAAGGAGAAGAAGGC
TCTATGCTCATCGTGATAAAGTGGAGTTTTTAGGAAAGTAAGCTTTAAGCTGCTTTTACCAGTTGAACTCCAAAA
ATAATGTAGGAGAGAGATGGCTTTCTTTGTTTTTGTTTCAGTGGCGGGGCAAGGTAGAAGAAGGTGGCTTTTTAA
ATTATTTAGGTGTTACGTTGTTTTAACTAATTTTGAGCACTTGGTAGACAGAGGAGAACAAAATGTACATTAAAG
TTCACCTGTCAAATTTTCATTTGTAGAGGGAAGGATGGAGGTTCTAAATACCAGCAATCTTAAAAAAAAAAAAAA
ATATTAACTCCTTGTGTCTTACCTATTTTGTATAAAACGACATGTACAGATATTTCCAGCAATTTATGCACATT
CTTTAATTCTGTTCCAGTTGAACATATAGTTGACCAGATTAAATGCAGCAAACATCCAGGTGAAATTGAGTCATT
TCTTTTTTTGTGGAACTTCTGATTTCTGTCATTGAGTTAATTATATTAAAATTTGAAACCTGTACTTATTCCTA
CTAGTATCAGCACTTTTATTTTCAACTTCCACTGATCTTTTAAAATTGAGGCAATATGCAGTAAAATATTTAAA
TAATTGCATAAACACCACCAAAGAGATATCAGTTAGAAATGTCAGTACTGGTGAAACTAAGCTATTGGCTAGCAG
GCAGCAAGGCCATCATAGGATAGCTCATTCATCAACTGATGTACAAAAGTCAGAGTTTGACACCCTAATAGCATT
TTTATTTAATACATTATTTTTCACAGCATGGGCTGGACATGAATGGAATGTATGAAAGTTTGAAGACCTTTTAT
TTATCCATTTCTTTTTTTCCCAGATAAAATTTACATTTTACATTTGTTTCTTGCATGTATACTGTAAAAATT
ACTTCTGTTTGGTGGTGAAATTAAAACTTAATGGTGTTGGTTCTCTGAACAATTAGTATTTTGGTGTAGTAGTG
TTGTCTAGCCAAAAATCTCGTGAATTTACTTTTAATGAAAAGAATTGCCAAATGAGTGAATGGGAAGATTTGTG
GGTGTCTTATTTGCATTTTATTACCATAACCTGACTTTGTTTTCTAGGCTTTTTCTGGAACTGTTATAGAAAAA
GAATTTGTATCACCTTCCTTAACACCACCCCCAGCCATTGCTCATCCCGCACTACCCACTATTCCAGAACGAAAG
GAAGTTCTGTTGGAAGCATCTGAAGAAACTGGAAAGAGGGTTTCAAAGTTTAAAGCTGCCAGATTGCAACAGAAA
GACTAGGCCCTGTCTAGGAAATGGGAATTTACATCCTAAAACCTAGTTGTTCATTTGTTTAGAGTATCTATAGCA
AAATAGGTTACATGTAGTTTGAAATAAGGTATCCTGAGTTACTTTGGCAACAAGTTCTTTTACCCTTACCCGTGG
TATTTGAAAAAAATCAAGGTAACTGTCTGAATACTTTAATATCAGCTTGTTTTGTGAATTCTCTGAATACTGTCA
ACACTCCTATCTAAGTTTGCCTTTATGATGCAGTGGCAGCATTTTGAATTACTTTTCAAAGAATACTGTTCATAT
```

FIGURE 550B

```
GCATTGTTTTTGTGTTTCAAACTAAATACAGGCAGATTTGTGCCAGCTGTGATATTGTGCATACCATATGGACCA
TTTTAAAGAAAATTTTAAAATTTCAAATAGATTCAACAATTACATTACTTGCTTTCACATTTTAAAGGCACTTTA
AAAAAATCTACTTCTCTTGTAGGTTTTGCGGCTAGTTGGCTATTCAAGAAACCTCGCCCCTCTGAATGTCATACT
GTAATCTTTAAGGAAGAAAGCTACATGAATTAATTGTACTCTATGGGAAAATTTCTTTGGAAAGATATTTTGTAA
AACTTTTTTTCCAAGTAAAAACTTTATGAAACTTGGTCTCAAAAATGTTGTGAACTTTATGATTCAAAATTGAG
TACAGATATGTCCTTGATTCATATGTATGCTACATGTATCACACAACAGATCTGGAATTCTTTCAGTTCCTCAGA
TACTTCTCCCTTAGTTTTTGCAGTTTCACTGGGATTATGTTTTGGGAAACAAGGAAAGGTCTAGATGCTTAAACA
TTTTAAATAAAAATTCCTTACAGTTTCATCTTCCCAACATTTTCATTCTTTAAGGCTACTTTCCTACTAACTGAA
ATAACACATTTACTTTTACCACAATTCCTCAAAATAAATTTATTCTAACATTGAAAATAACATTACAAGTTAATC
ATTAGCTTGATGCATGCTAAAATGTAGCTTTTAAAAAGCATTCTGCATTAGTACTAAAATAAGCCATCAATGCCA
GTCCACCCTCTCTATTCATGGCTAAATATTTAAAGGTTATTTATAGCTTCTTTAATGAATTCTTCTTAAACAAAG
TGAAATTATGTCCTAGAAAAGTAGAAGCTATTCGTAACTAGAGCAGTGCAACTTTAAAGTTTTATGAATATGTAT
TTTAATGACAAGGGGGCGAGCTTGCATCCCCACTAGTTAATGGATAATTCAAACCGAGGACTGATTTTGAAAGAT
CACCTAAAAATGTAGATTTGTTCTTTAGTAAATTTAGATCAACTATGCATATATTTTGTAGGTAAATCTTTCAGT
CCATGCCCCAACCCTCACCAAAACCAAAGCAGAAATTACACACACAAAGATGCTCCCGTTAGGAATTGCTATTCA
CATGAGGCTTTCTGTGCTAGATTTTTTTCTCAGAAACAAACTTTACTGTAGGACTATTGTGGTGTTCTTAACAGA
TTTGTAATTTCAAGATGCGTGTCATTAAATAATTTTTCATGTTCACAGACAAA
```

FIGURE 551

```
MEKIPHLLKRYTSCDKDVASSEPFSGQVNSQLNCSVNGSRSYHXXXXXXXXXXXXXXXIDDDDGDNDHEALGVGDN
SIPTIYFSHTVEPKRVRINTGKNTTLKFSEKKEEAKRKRKNSTGSGHSAQELPTIRTPADIYRAFVDVVNGEYVP
RKSILKSRSRENSVCSDTSESSAAEFDDRRGVLRSISCEEATCSDTSESILEEEPQENQKKLLPLSVTPEVCVCI
F
```

FIGURE 552

```
GTGCAGAAAGCACCGTCTTTTACTAGAAGAAGACAATAAAATGTTGGTCAATGAACTGAATCATTCGAAAGAAAA
AGAATGCCAATATGAAAAAGAGAAAGCAGAAAGAGAAGTAGCTGTGAGACAGCTTCAACAAAAACGAGATGATGT
CTTAAACAAAGGATCAGCAACAAAAGCTCTGCTGGATGCTTCATCGCGTCACTGCACCTATTTAGAAAATGGGAT
GCAGGATTCAAGGAAGAAATTAGACCAGATGAGAAGTCAATTTCAAGAAATACAGGATCAACTTACAGCTACTAT
AAGATGTACTAAGGAGATGGATGGCGACACACAAAAGCTTGAAGTAGAACATGTGATGATGAGAAAAATTATTAA
AAAACAGGATGACCAAATTGAGCGGCTTGAGAAAATCCTGCAGCATTCAAGTTTGATGCTGCAGGTGTTTGAGAG
CTAGATGAAGATATGGACATTTCTGGAATTAAGAGCCCCCTCTACATTGAGCACAAGACAGTGACGAATCCACAT
TCTTCAGCCAGAAAGTCACCTCTGAGAGCCAAATGTCTGACTATAGAAAGGAGAGTCAAAGAATGATAACGACAT
CTCAGGAAATTGTGAAAATAATCAGCAGCCGGATGTGGATAACCCTTTCAAATTTCTCCTGGGGCCTCCAACCA
CCCCCACTGGTGTTCTCCTGCTGACAGTGATTTCAATTTTTTCTGGGCTGGAGCTCCCTGATGGAGGGGCAGGCC
ACCATCTTTGCTGTTTTTGCAACTTAGCCACTTCAGCCTTCAGTCTTTGGAGTGTCCAAGGAGACCAGGGGGTGA
TGTGGACCCTCAGCATAGCACAGCTGCTCTATAAAGATGAGGCCAGACTGCTTTTTTGAGCACTTTCCCAATGCC
ATTCCTCCTCACTGGGCAAAACCTCCAAACTGGGGTCTCCAGCCACCTCCTACAGGTGTGTTTGGGCCAGCAACA
AGTTCATTCATACCTCCCTAGGGCAAAGCTTCCAAAGGGAGCGGTAGGCTGCCATCTTTGCTGTTTCACAGGCTT
CACTGATGATAACTCCAGGTACTGGAAAATCTGAGGCTACTAGAGACTGGAGCGGGCCCTGGGCATACTGCAGCA
GCCCTATGGAAAAGTGGCCAGACTGTTACCTGGGTTCCCATTCCTATATCTTCTCACTAGGCAAGTCTTGCAGGC
CTGGGCCTCTACCTAACCCCCCCTACCAGAACTGTTGAGCCAGTAGCAACTCAGCCACTCCCTGGAGAGAGCCTC
CAGGGGCAACTGAAAGCCTCTCTGCCACTGCTTCTGCAGTGGAACTGTCCTTGCTACCCTCAGACTGATGAAGGA
GCTAACACCCTTATCTACACCTTCAACAAGCTTTAATTGACCAAAGCCCATCTCTCATGGGTTCTACACACTCCC
CACTGCTCATGACAGGGAACCCCTGGATTGGCCCCCACAGCACGAATTCTCCATCCTGATTGCTGATTGCAGTAA
ACAGTTGCTGTATTCTCCAGGGGTGGTGGAACTCTGAGGAGACAAACAAAAGACCCTTGGCTACAACCACTACTA
ATGTCCCTTCCTCTTCTGCCTCAAAGTTAGGAAAGAAATATAAACACTGAGATTGCCCCAGAGCTGCAGTGGGCA
GCCTAGGAGTGCCAAGCCATGACCTACAGCCAGCACTCAAGGGGAGAGAAGCACATTTTCAGATCATTGAGAGG
GAACATGGCTGCAACTGTAAGGAAACATAGGGGAGCCACATGACCAAGCAAGAGTCTACCAACTGACCAGTAAGC
CCAAGTGCCACCTACTGGATCACATCCCAAAGCTTCAGCATCAAAAATACCCTACTAATATACTCCCCTCTGAAA
CCAGAAATGAGAAGTCAGCTTCAAATAAAGACCCTGCACAAAGCCTCAGCCTGGTGAAAACATCCGAAAATAAGT
CTACGGACTGTACTCAATCTACACTGCAATTAAAGGAAAACCCATAGGTGGAAATGAGAAGAAACCAATGCAAGA
ACTCCAGTAACTCAAATGGCCTCTGTGTCATATGTCCTTCTAACAACCACACCAGTTCTCCAACAAGAGTTCTTA
ACCTGGATGAACTGTCTGGAATTACATAAATATAATTCAGAATATGGATAGGAAAAAAAATCATCAAGACTCAGG
AGAATGGCAAAACCCAATCCAAGGAAAATAAGAATAACAGTAAAGTGTTACAGGAGCTGAAGGATAAAGTAGCTG
GTATAATAAAAAAGAACCTAACCGATCTGAAAGCGCCGAAGAACACAATACAAGAATTCCACAATGCAATCACAA
GTATTAACAGCAGAAAAAAAAACCTGAGGAACGAATCTCAGAACTTGAAGATTGGTTCTCTAAAATAAGATGGAC
AAAAAAAAAAAAAAAAAA
```

FIGURE 553

MLVNELNHSKEKECQYEKEKAEREVAVRQLQQKRDDVLNKGSATKALLDASSRHCTYLENGMQDSRKKLDQMRSQ
FQEIQDQLTATIRCTKEMDGDTQKLEVEHVMMRKIIKKQDDQIERLEKILQHSSLMLQVFES

FIGURE 554

CACAGACTCAGAGAGAACCCACCATGGTGCTGTCTCCTGCCGACAAGACCAACGTCAAGGCCGCCTGGGGTAAGG
TCGGCGCGCACGCTGGCGAGTATGGTGCGGAGGCCCTGGAGAGGATGTTCCTGTCCTTCCCCACCACCAAGACCT
ACTTCCCGCACTTCGACCTGAGCCACGGCTCTGCCCAGGTTAAGGGCCACGGCAAGAAGGTGGCCGACGCGCTGA
CCAACGCCGTGGCGCACGTGGACGACATGCCCAACGCGCTGTCCGCCCTGAGCGACCTGCACGCGCACAAGCTTC
GGGTGGACCCGGTCAACTTCAAGCTCCTAAGCCACTGCCTGCTGGTGACCCTGGCCGCCCACCTCCCCGCCGAGT
TCACCCCTGCGGTGCACGCCTCCCTGGACAAGTTCCTGGCTTCTGTGAGCACCGTGCTGACCTCCAAATACCGTT
AAGCTGGAGCCTCGGTAGCCGTTCCTCCTGCCCGCTGGGCCTCCCAACGGGCCCTCCTCCCCTCCTTGCAC

FIGURE 555

MVLSPADKTNVKAAWGKVGAHAGEYGAEALERMFLSFPTTKTYFPHFDLSHGSAQVKGHGKKVADALTNAVAHVD
DMPNALSALSDLHAHKLRVDPVNFKLLSHCLLVTLAAHLPAEFTPAVHASLDKFLASVSTVLTSKYR

FIGURE 556

```
TGGAAGAATAATTAAAGATCTTTTTTTTTTTTTTTAAAGCAAAAAGCTAGACAATTGTTTCATCATTTTTAT
TAAATCACCTGTCTTTCTCCACAGATACAAATGCTATGTCTAAATTTTATCACAGTCTTGGGTCTGTTGTTGGG
CTGTCTTTTGCTCCATTGATGTGTCTTTTGGCAACTGTGGCTTTTTGTTTCACTGTACTTCTTTATTTGTCATAA
TATTGAGGCATATTCTTTGTAATTCTTGTTTTAGAATTTTCATAGCTATTCATTCTCATGCTTCTCAGTGTTTT
CTGAAGTCATTCATCATTTTCTAGAAAATTTATGATTGGCATTTTGATTGGAATCCCTTGGAATTCATCAGTTAG
AGTTGACTACTGTAGGCTATTAAAACGTCTTCCTATAAGAATGTAGATATCAGACTGGTGAAAATTTAAGGAGCT
GAAGTAATTTTAAATTTTAATTGTAAGATTTTCGTGGAGGTGATTTTTCAAAAAGGTTTAGTTACTGATGTTGGT
TCCTGTGTTATTTCTGGTAGATGAATCAATTATATTAGGTAAAAGTATTATCATTGGCATGATTAAAAAGATGTT
TTAGCTTAAAACCTAAATGATGGGTTGATAGGTACAGCAAGCCACCACAGCATGTATACAACCTGCATGTTCT
GCACATGTATGTAACAAACCTGCATGTTCTGCACGTGTGTTTAACAAACCTGCATGT
```

MCIQPACSAHVCNKPACSARVFNKPA

```
TGATTATATTTGCAGGAAGTCAGCCTCATACCAAACCATCCGTTTTTGTCATGAAAAATGGAACAAATGTCGCTT
GTCTGGTGAAGGAATTCTACCCCAAGGATATAAGAATAAATCTCGTGTCATCCAAGAAGATAACAGAGTTTGATC
CTGCTATTGTCATCTCTCCCAGTGGGAAGTACAATGCTGTCAAGCTTGGTAAATATGAAGATTCAAATTCAGTGA
CATGTTCAGTTCAACACGACAATAAAACTGTGCACTCCACTGACTTTGAAGTGAAGACAGATTCTACAGGTAGGC
C
```

FIGURE 559

IIFAGSQPHTKPSVFVMKNGTNVACLVKEFYPKDIRINLVSSKKITEFDPAIVISPSGKYNAVKLGKYEDSNSVT
CSVQHDNKTVHSTDFEVKTDST

FIGURE 560

```
TGCAGGAGAATGGCTACTCATCACACGCTGTGGATGGGACTGGCCCTGCTGGGGGTGCTGGGCGACCTGCAGGCA
GCACCGGAGGCCCAGGTCTCCGTGCAGCCCAACTTCCAGCAGGACAAGTTCCTGGGGCGCTGGTTCAGCGCGGGC
CTCGCCTCCAACTCGAGCTGGCTCCGGGAGAAGAAGGCGGCGTTGTCCATGTGCAAGTCTGTGGTGGCCCCTGCC
ACGGATGGTGGCCTCAACCTGACCTCCACCTTCCTCAGGAAAAACCAGTGTGAGACCCGAACCATGCTGCTGCAG
CCCGCGGGGTCCCTCGGCTCCTACAGCTACCGGAGTCCCCACTGGGGCAGCACCTACTCCGTGTCAGTGGTGGAG
ACCGACTACGACCAGTACGCGCTGCTGTACAGCCAGGGCAGCAAGGGCCCTGGCGAGGACTTCCGCATGGCCACC
CTCTACAGCCGAACCCAGACCCCCAGGGCTGAGTTAAAGGAGAAATTCACCGCCTTCTGCAAGGCCCAGGGCTTC
ACAGAGGATACCATTGTCTTCCTGCCCCAAACCGATAAGTGCATGACGGAACAATAGGACTCCCCAGGGCTGAAG
CTGGGATCCCGGCCAGCCAGGTGACCCCCACGCTCTGGATGTCTCTGCTCTGTTCCTTCCCCGAGCCCCTGCCCC
GGCTCCCCGCCAAAGCACCCCTGCCCACTCGGGCTTCATCCTGCACAATAAACTCCGGAAGCAAGTCAGTTAAAA
AAAAAAAAAAAAAAAAAAAAAAAAAA
```

FIGURE 561

MATHHTLWMGLALLGVLGDLQAAPEAQVSVQPNFQQDKFLGRWFSAGLASNSSWLREKKAALSMCKSVVAPATDG
GLNLTSTFLRKNQCETRTMLLQPAGSLGSYSYRSPHWGSTYSVSVVETDYDQYALLYSQGSKGPGEDFRMATLYS
RTQTPRAELKEKFTAFCKAQGFTEDTIVFLPQTDKCMTEQ

FIGURE 562

```
TTCCCATCCGCACCAGCAAGAGGGCCCCTGTGCCCCAAACGCGAACCGTACGGCTCCAGACAGCACCGCGGAACT
CGGTGGCTTCCAGAAGGCCCCGCGCCTGCGCATTCCGCTGCCTGCGCCTGCGCCTGCGCCTGCGCCGTTCTCCCG
GCCGCCGCCTTAGCACCTCCTCCGGACGGTGTCGCCGAAGTCTCGCGAGCCCGGAGCGTGGCACGTGGGCCCCCT
CCGCCTCCGGCTCCGTCCTCCTCTGGCCCCCTCCGCCCCGGCCCCGGCCCCACGGCGGGATGCGGGACAACACC
AGCCCCATCAGCGTGATTCTGGTGAGCTCGGGGAGCAGGGGCAATAAGCTGCTGTTCAGGTACCCCTTCCAGAGA
AGCCAGGAGCACCCGGCGTCCCAGACAAGTAAGCCGCGTAGCAGATACGCTGCCAGCAACACGGGCGACCATGCT
GATGAGCAGGACGGCGATTCCAGGTTTTCAGATGTTATTCTGGCAACAATTTTGGCAACCAAGTCTGAAATGTGT
GGCCAAAAATTTGAACTGAAGATTGATAATGTGCGATTTGTTGGGCACCCAACACTGCTACAGCATGCTCTGGGG
CAGATCTCCAAAACAGATCCTTCCCCGAAGAGGGAAGCACCTACTATGATTCTTTTTAATGTGGTGTTTGCACTG
AGGGCCAACGCAGACCCGTCAGTGATAAACTGTCTGCATAACCTGTCCCGTCGTATCGCCACCGTGCTGCAGCAC
GAGGAGCGCCGCTGCCAGTACCTCACCCGGGAGGCCAAGCTGATCCTGGCGCTCCAGGATGAGGTGTCCGCCATG
GCTGATGGAAATGAAGGTCCTCAGTCCCCATTCCATCACATCCTGCCCAAGTGCAAGCTGGCCAGGGACCTCAAG
GAAGCTTATGACAGCCTGTGCACGTCGGGCGTAGTTCGGCTTCACATCAACAGCTGGCTGGAGGTGAGCTTCTGC
CTGCCCCACAAGATCCACTATGCGGCCTCCAGTCTGATCCCCCCAGAGGCCATCGAACGGAGCCTGAAAGCCATC
CGCCCCTACCATGCCCTGCTGCTGCTCAGTGATGAGAAGTCCTTGCTGGGTGAGCTTCCTATTGACTGCTCCCCT
GCCCTAGTGCGGGTGATCAAGACCACATCTGCTGTGAAGAACCTGCAGCAGCTAGCCCAAGATGCGGACCTGGCC
TTGCTGCAGGTTTTCCAGCTTGCAGCTCATCTGGTGTACTGGGGCAAGGCCATCATCATCTACCCGCTGTGTGAG
AACAACGTCTACATGCTGTCTCCCAATGCCAGCGTATGTCTGTACTCCCCGCTGGCCGAGCAGTTCTCCCACCAG
TTCCCATCTCATGACCTGCCGTCCGTTCTTGCCAAGTTCTCCTTGCCGGTCTCCTTGTCAGAATTTAGGAATCCC
CTGGCCCCCGCTGTGCAGGAGACCCAGCTCATCCAGATGGTGGTGTGGATGCTGCAGCGCCGGCTTCTCATCCAG
CTGCACACCTATGTCTGCCTGATGGCCTCACCCAGCGAGGAGGAGCCCCGTCCGCGAGAGGACGACGTCCCCTTC
ACTGCCCGGGTCGGCGGTCGCAGCCTCAGCACGCCCAACGCCCTCAGCTTTGGCTCCCCAACCAGCAGCGATGAC
ATGACCCTCACCAGCCCCAGCATGGACAACTCCAGCGCAGAGCTACTTCCCAGCGGGGACTCGCCACTGAACCAG
AGGATGACGGAGAACCTGCTGGCCAGCCTGTCGGAGCATGAACGCGCAGCCATCCTCAGTGTACCCGCAGCCCAG
AACCCTGAGGACCTCCGCATGTTTGCCAGGCTCCTTCACTACTTCCGCGGCCGCCACCACCTGGAGGAGATTATG
TACAACGAGAACACGCGGCGCTCCCAGCTGCTCATGCTGTTTGACAAGTTCCGCAGCGTGCTGGTGGTGACCACC
CACGAGGACCCTGTCATTGCCGTCTTCCAGGCTCTGCTCCCCTGAGCCCAGGCGGAGGGCGGAAGGCTGCTGGGG
TGCGCAGGTGGGCGCTCGCGTCTCCCCACCCCAGGGCTCCCCCGTGCTGAGGCTGAGCCCTCTTGGCCCTGAGG
CCTGGCATTGGGTGGATGCGGGCTGGCCGTGGCCCAGTGAAGCCTGCAGAGCCCCGCTGTCCTTGCCCCTGGTGG
TTCCGCTGTGGGCTGCTGCCCTCTGTGTTCCTACGCTTCCCTCCAGTCCTTGCCGCACGCGTAGGCATCTCCAC
GCTGGAGGGGGCCTGCCAGGACTCCTGTCTCTGGGTGAGGCCGCATCCTTCAAGGCCCATGTGGGCTGTGCGTT
TCTCAGACCCTCCTTCTGTCCCTACACCTGCTCCTTGGACCCCCCAGTCTGTGGCCACCCTGAAGAATGTGCAGA
AACACTTGTGTGGCCTGTCCCTGTCTCTCTGACAGCCTTCCATTTGTGAAGTGCCCTGTGGCCCCCTCCCCAGCA
CCTCTGTCTGCCATGCGCTTCTTCCTCCCAGGCTACCCTGAGCCTTTCCTGGCCCAGTCCTCACCACAGTCCACA
GAAGCCACAAACAGGCTCATAGCCAAGCTGTGACCTGGTCCTGACCATCTGGGGCACGAGGGCCTGGGCTGGCCC
TGCTAGGCTGGAGAAGCCCTGTCACCTGTGCACATCTTGCTGGTGGAGGCATGGCCCACTGTGCAGGACCCCACC
CTCGGGGGCTTTCGGCTCCCACACTGATGATTCTCCCCAGCATCCACACCGGGCCTGGCGCTACGTACTCAGGCC
CCCAGCTCTCGTGTCCTGGAGGAAGAGCTAGCTCCAGACATGGGTTGATCACCTAGAGGAGCTCTGGCTAAGGCA
CAGTTTTCTAGAAATAAAACATTTATTCGGGTTTGGAAAGGCCCCTTGGATTCCTGGCTGGGGACAATGATGACC
TGGACCCTGGCCAGAAGAGCCCTGGCCCTCCAGCAAGGCAGCACCTGCTCTGATGCACCTGTGCACCCCTGGCCC
TCCCAGCCACCTGGGAGCCCGAAGCTTAGCCTGTAGGTGGCCAAGCCAGTCCCTACTCTTGGGCTGCGGCCACGT
GAGGCTCCGCATCAGCAGCCAGGGGCGAGCACTAGTGGACAAAGCCAGCAAATGCGGCGTTCCTGTGAGCAGATA
CCCTCAACCAGCCAGCTGTCAAAAGTATTTCAAGATAAAATCCAGGCCAAGC
```

FIGURE 563

```
MRDNTSPISVILVSSGSRGNKLLFRYPFQRSQEHPASQTSKPRSRYAASNTGDHADEQDGDSRFSDVILATILAT
KSEMCGQKFELKIDNVRFVGHPTLLQHALGQISKTDPSPKREAPTMILFNVVFALRANADPSVINCLHNLSRRIA
TVLQHEERRCQYLTREAKLILALQDEVSAMADGNEGPQSPFHHILPKCKLARDLKEAYDSLCTSGVVRLHINSWL
EVSFCLPHKIHYAASSLIPPEAIERSLKAIRPYHALLLLSDEKSLLGELPIDCSPALVRVIKTTSAVKNLQQLAQ
DADLALLQVFQLAAHLVYWGKAIIIYPLCENNVYMLSPNASVCLYSPLAEQFSHQFPSHDLPSVLAKFSLPVSLS
EFRNPLAPAVQETQLIQMVVWMLQRRLLIQLHTYVCLMASPSEEEPRPREDDVPFTARVGGRSLSTPNALSFGSP
TSSDDMTLTSPSMDNSSAELLPSGDSPLNQRMTENLLASLSEHERAAILSVPAAQNPEDLRMFARLLHYFRGRHH
LEEIMYNENTRRSQLLMLFDKFRSVLVVTTHEDPVIAVFQALLP
```

FIGURE 564

CGCAGGGCAGGATGTACACGCTGCTGTCGGGCTTGTACAAGTACATGTTTCAGAAGGACGAGTACTGCATCCTGA
TCCTGGGCCTGGACAATGCTGGGAAGACGACCTTCCTGGAGCAGTCGAAAACCCGATTTAACAAGAACTACAAGG
GGATGAGTCTATCCAAAATCACCACCACCGTGGGCCTAAACATCGGCACTGTGGATGTGGGAAAGGCTCGGCTCA
TGTTCTGGGACTTAGGAGGGCAGGAAGAGCTGCAGTCTTTGTGGGACAAGTATTATGCGGAGTGTCACGGCGTCA
TCTACGTCATTGACTCCACCGACGAGGAGAGGCTGGCTGAGTCCAAGCAGGCGTTTGAGAAGGTGGTGACCAGCG
AGGCGCTGTGCGGTGTCCCCGTCTTGGTGCTGGCCAACAAGCAGGATGTGGAGACGTGCCTCTCAATCCCTGACA
TCAAGACGGCCTTCAGCGACTGCACCAGCAAGATCGGCAGGCGCGATTGCCTGACCCAGGCCTGCTCGGCCCTCA
CAGGCAAAGGGGTGCGCGAGGGCATCGAGTGGATGGTGAAGTGTGTCGTGCGGAATGTGCACCGGCCGCCGCGGC
AGAGGGACATCACGTAGCGGCAGCCGCGCTGCCGTCGGGACGGCTGGTCCCCTGGTGCTGGAGGAGTGGCCTCCT
GTTGGCTCCCATGCTGCTGATCTGGGGGGTGGGTTTGCTTTGCTTTGGGGTTCTTCTATTTACTTTGTTTTCTCG
AAGACAAACTTTCCTCTATGTCTGGAAAAGCGTAGGCATCCGGAGGCTTTGGAGGGGAGTCTGGCAGCCCGGCTG
GCCCAGGCCCTGCAGCGGCAGCCTTTCCACAGGGCGCAGCGGCGGCCTTTCGAGGCCCTTTCTGGGGGGTCTGAG
GGAGACCTGGTTGGGAATTGGGGCTCCAGTGCTCAGGCTGGCTTGGGCTGCATGAGGACAGCCCTGTGGGACCCT
CGGGAGACCCCGTGGCTGTCTCCGCCCCATCGAGGAGGAGGCCCGTCAGCCATGGCTGCCATCTGGCTTCTGCCC
TGTGACCCCGTGACCCCGGAAGTGGTCTGGGCTGATCTTGCCTTGAGGAAGACCCAGGCCATGTTCCCAAAGGC
CAGCGGGGGCCCTGGATTGTGATGCAGCCTCGGGACAGGGCTGAGGCCTGCGGGGGAAGACCTATACCCCACGCC
TGGGCCTGGCTTCACCTCACCCTAATCCCCCGGGAGGGAGCTGACTGATGCAAAAAGCTGAGGGGGCCTGCTGGG
AGTGGCTGTTTTTATGCCCCAGCCCCGCAAGTTGGGGAGTGTTTGTGGGGGTCCAGAGCCCTCCCCCAGCCAGGA
GAGAACCTCCCGGAGGGGTTCTCTGTGGGCCCTGTGTCCCCTGCTCGGGAGTAAGGCTGGTCCTGGGGTCCTCC
CTGCACGGACCCCACTGGGCCTGCCGAGTGCTGTGTTCTTCCTCAGTCTGGCTGTGGGCAGGAGCGGCCTGCCCA
GTGTCACCCAGGGTGAGTGCAAAATAAAGACGGCGAGTGTGAAAAAAAAAAAAAAAAAAA

FIGURE 565

MYTLLSGLYKYMFQKDEYCILILGLDNAGKTTFLEQSKTRFNKNYKGMSLSKITTTVGLNIGTVDVGKARLMFWD
LGGQEELQSLWDKYYAECHGVIYVIDSTDEERLAESKQAFEKVVTSEALCGVPVLVLANKQDVETCLSIPDIKTA
FSDCTSKIGRRDCLTQACSALTGKGVREGIEWMVKCVVRNVHRPPRQRDIT

FIGURE 566A

```
CGCGCCGGGGCCTGGTGCTCGGTCGGCGGGTGCTGCCGCTTTAAGCGGGGGCGGGACTGCGCGCGGCCGAGCGGT
TGCGACGAGGGCTCGGCTGGGGGTCGCCGGGGTCGCGGGCCGGGCCTGCAGGAGCCGGGCCGCCGAGGTCGGGGC
TGGTTGAACTCATGGACCTGATACTTTTCTCTTGAGAAGCAAACCAGCCCAAAAGAAAAATGGCGTTTGTTGCAA
CACAGGGGCCACGGTGGTTGACCAGACCACTTTGATGAAAAAGTACCTTCAGTTTGTGGCAGCTCTCACAGATG
TGAATACACCTGATGAAACAAAGTTGAAAATGATGCAAGAAGTTAGTGAAAATTTTGAGAATGTCACGTCATCTC
CTCAGTATTCTACATTCCTAGAACATATCATCCCTCGATTCCTTACATTTCTCCAAGATGGAGAAGTTCAGTTTC
TTCAGGAGAAACCAGCACAGCAACTGCGGAAGCTCGTACTTGAAATAATTCATAGAATACCAACCAACGAACATC
TTCGTCCTCACACAAAAATGTTTTGTCTGTGATGTTTCGCTTTTAGAGACGGAAAATGAAGAAAATGTTCTTA
TTTGTCTAAGAATAATTATTGAGCTACACAAACAGTTCAGGCCACCGATCACACAAGAAATTCATCATTTCTGG
ATTTGTGAAACAGATTTACAAGGAGCTTCCAAAAGTAGTGAACCGCTACTTTGAGAACCCTCAAGTGATCCCCG
AGAACACAGTGCCTCCCCCAGAAATGGTTGGTATGATAACAACGATTGCTGTGAAAGTCAACCCGGAGCGTGAGG
ACAGTGAGACTCGAACACATTCCATCATTCCGAGGGGATCACTTTCTCTGAAAGTGTTGGCAGAATTGCCCATTA
TTGTTGTTTTAATGTATCAGCTCTACAAACTGAACATCCACAATGTTGTTGCTGAGTTTGTGCCCTTGATCATGA
ACACCATTGCCATTCAGGTGTCTGCACAAGCGAGGCAACATAAGCTTTACAACAAGGAGTTGTATGCTGACTTCA
TTGCTGCTCAGATTAAAACATTGTCATTTTAGCTTACATTATCAGGATTTACCAGGAGTTGGTGACTAAGTATT
CTCAGCAGATGGTGAAAGGAATGCTCCAGTTACTTTCAAATTGTCCAGCAGAGACTGCACACCTCAGAAAGGAGC
TTCTGATTGCTGCCAAACACATCCTCACCACAGAGCTGAGAAACCAGTTCATTCCTTGCATGGACAAGCTGTTTG
ATGAATCCATACTAATTGGCTCAGGATATACTGCCAGAGAGACTCTAAGGCCCCTCGCCTACAGCACGCTGGCCG
ACCTCGTGCACCATGTCCGCCAGCACCTGCCCCTCAGCGACCTCTCCCTCGCCGTCCAGCTCTTCGCCAAGAACA
TCGACGATGAGTCCCTGCCCAGCAGCATCCAGACCATGTCCTGCAAGCTCCTGCTGAACCTGGTGGACTGCATCC
GTTCCAAGAGCGAGCAGGAGAGTGGCAATGGGAGAGACGTCCTGATGCGGATGCTGGAGGTTTTCGTTCTCAAAT
TCCACACAATTGCTCGGTACCAGCTCTCTGCCATTTTAAGAAGTGTAAGCCTCAGTCAGAACTTGGAGCCGTGG
AAGCAGCTCTGCCTGGGGTGCCCACTGCCCCTGCAGCTCCTGGCCCTGCTCCCTCCCCAGCCCCTGTCCCTGCCC
CACCTCCACCCCGCCCCCACCCCCACCTGCCACCCCTGTGACCCCGGCCCCCGTGCCTCCCTTCGAGAAGCAAG
GAGAAAAGGACAAGGAAGACAAGCAGACATTCCAAGTCACAGACTGTCGAAGTTTGGTCAAAACCTTGGTGTGTG
GTGTCAAGACAATCACGTGGGGCATAACATCATGCAAAGCACCTGGTGAAGCTCAGTTCATTCCCAACAAGCAGT
TACAACCCAAAGAGACACAGATTTACATCAAACTTGTGAAATATGCAATGCAAGCTTTAGATATTTATCAGGTCC
AGATAGCAGGAAATGGACAGACATACATCCGTGTGGCCAACTGCCAGACTGTGAGAATGAAAGAGGAGAAGGAGG
TATTGGAGCATTTCGCTGGTGTGTTCACAATGATGAACCCCTTAACGTTCAAAGAAATCTTCCAAACTACGGTCC
CTTATATGGTGGAGAGAATCTCAAAAAATTATGCTCTTCAGATTGTTGCCAATTCCTTCTTGGCAAATCCTACTA
CCTCTGCTCTGTTTGCTACGATTCTGGTGGAATATCTCCTTGATCGCCTGCCAGAAATGGGCTCCAACGTGGAGC
TCTCCAACCTGTACCTCAAGCTGTTCAAGCTGGTCTTTGGCTCTGTCTCCCTCTTTGCAGCTGAAAATGAACAAA
TGCTGAAGCCTCACTTGCACAAGATTGTGAACAGCTCTATGGAGCTCGCGCAGACTGCCAAGGAACCCTACAACT
ACTTCTTGCTGCTACGGGCGCTGTTTCGCTCTATTGGTGGAGGTAGCCACGATCTCTTGTATCAGGAGTTCTTGC
CTCTCCTTCCAAACCTCCTGCAAGGGCTGAACATGCTTCAGAGTGGCCTGCACAAGCAGCACATGAAGGACCTCT
TTGTGGAGCTGTGTCTCACCGTCCCTGTGCGGCTGAGCTCGCTTTTGCCGTACCTGCCCATGCTTATGGATCCCT
TGGTGTCTGCACTCAATGGGTCTCAGACATTGGTCAGCCAAGGCCTCAGGACGCTGGAGCTGTGTGTGGACAACC
TGCAGCCCGACTTCCTCTACGACCACATCCAGCCGGTGCGCGCAGAGCTTATGCAGGCTCTGTGGCGCACCTTAC
GCAACCCTGCTGACAGCATCTCCCACGTGGCCTACCGTGTGCTCGGTAAGTTTGGCGGCAGTAACAGGAAGATGC
TGAAGGAGTCGCAGAAGCTGCACTACGTTGTGACCGAGGTTCAGGGCCCCAGCATCACTGTGGAGTTTTCCGACT
GCAAAGCTTCTCTCCAGCTCCCCATGGAGAAGGCCATTGAAACTGCTCTGGACTGCCTGAAAAGCGCCAACACTG
AGCCCTACTACCGGAGGCAGGCGTGGGAAGTGATCAAATGCTTCCTGGTGGCCATGATGAGCCTGGAGGACAACA
AGCACGCACTCTACCAGCTCCTGGCACACCCCAACTTTACAGAAAAGACCATCCCCAATGTTATCATCTCACATC
GCTACAAAGCCCAGGACACTCCAGCCCGGAAGACTTTTGAGCAGGCCCTGACAGGCGCCTTCATGTCTGCTGTCA
TTAAGGACCTGCGGCCCAGCGCCCTGCCCTTTGTCGCCAGCTTGATCCGCCACTATACGATGGTGGCAGTCGCCC
AGCAGTGTGGCCCTTTCTTGCTGCCTTGCTACCAGGTGGGCAGCCAGCCCAGCACAGCCATGTTTCACAGTGAAG
AAAAATGGCTCAAAGGAATGGATCCTTTGGTTCTCATTGATGCAATTGCTATTTGTATGGCATATGAAGAAAAGG
AGCTTTGCAAAATCGGGGAGGTGGCCCTAGCTGTGATATTTGATGTTGCAAGTATCATCCTGGGCTCCAAGGAGA
```

FIGURE 566B

```
GGGCCTGCCAGCTGCCCCTGTTTTCTTACATCGTGGAGCGCCTGTGTGCATGTTGTTATGAACAGGCGTGGTATG
CAAAGCTGGGGGGTGTGGTGTCTATTAAGTTTCTCATGGAGCGGCTGCCTCTCACTTGGGTTCTCCAGAACCAGC
AGACATTCCTGAAAGCACTTCTCTTTGTCATGATGGACTTAACTGGAGAGGTTTCCAATGGGGCAGTCGCTATGG
CAAAGACCACGCTGGAGCAGCTTCTGATGCGGTGCGCAACGCCTTTAAAAGACGAGGAGAGAGCCGAAGAGATCG
TGGCCGCCCAGGAAAAGTCTTTCCACCATGTGACACACGACTTGGTTCGAGAAGTCACCTCTCCAAACTCCACTG
TGAGGAAGCAGGCCATGCATTCGCTGCAGGTGTTGGCCCAGGTCACTGGGAAGAGTGTCACGGTGATCATGGAAC
CCCACAAAGAGGTCCTGCAGGATATGGTCCCCCCTAAGAAGCACCTGCTCCGACACCAGCCTGCCAACGCACAGA
TTGGCCTGATGGAGGGGAACACGTTCTGTACCACGTTGCAGCCCAGGCTCTTCACAATGGACCTTAACGTGGTGG
AGCATAAGGTGTTCTACACAGAGCTGTTGAATTTGTGTGAGGCTGAAGATTCAGCTTTAACAAAGCTGCCCTGTT
ATAAAAGCCTTCCGTCACTCGTACCTTTACGAATTGCGGCATTAAATGCACTTGCTGCCTGCAATTACCTTCCTC
AGTCCAGGGAGAAAATCATCGCTGCACTCTTCAAAGCCCTGAATTCCACCAATAGTGAGCTCCAAGAGGCCGGAG
AAGCCTGTATGAGAAAGTTTTTAGAAGGTGCTACCATAGAAGTCGATCAAATCCACACACATATGCGACCTTTGC
TGATGATGCTGGGAGATTACCGGAGCTTGACGCTGAATGTTGTGAATCGCCTGACTTCGGTCACGAGGCTCTTCC
CAAATTCCTTCAATGATAAATTTGTGATCAGATGATGCAACATCTGCGCAAGTGGATGGAAGTGGTGGTGATCA
CCCACAAAGGGGGCCAGAGGAGCGACGGAAACGAAATGAAGATTTGCTCAGCAATTATAAACCTTTTTCATCTGA
TCCCGGCTGCTCCTCAGACACTGGTGAAGCCTTTGCTAGAGGTTGTCATGAAAACGGAGCGGGCGATGCTGATCG
AGGCGGGGAGTCCATTCCGAGAGCCCCTGATCAAGTTCCTGACTCGACATCCCTCGCAGACAGTGGAGCTGTTCA
TGATGGAAGCCACACTGAACGATCCCCAGTGGAGCAGAATGTTTATGAGTTTTTAAAACACAAAGACGCCAGAC
CTCTGCGGGATGTGCTGGCTGCCAACCCCAACAGGTTCATCACCCTGCTGCTGCCGGGGGTGCCCAGACGGCTG
TGCGCCCCGGTTCGCCCAGCACCAGCACCATGCGCCTGGACCTCCAGTTCCAGGCCATCAAGATCATAAGCATTA
TAGTGAAAAACGATGACTCCTGGCTGGCCAGCCAGCACTCTCTGGTGAGCCAGTTGCGACGTGTGTGGGTGAGTG
AGAACTTCCAAGAGAGGCACCGCAAGGAGAACATGGCAGCCACCAACTGGAAGGAGCCCAAGCTGCTGGCCTACT
GCCTGCTGAACTACTGCAAAAGGAATTACGGAGATATAGAATTGCTGTTCCAGCTGCTCCGAGCCTTTACTGGTC
GTTTTCTCTGCAACATGACATTCTTAAAAGAGTATATGGAGGAAGAGATTCCCAAAAATTACAGCATCGCTCAGA
AACGTGCCCTGTTCTTTCGCTTTGTAGACTTCAACGACCCCAACTTCGGAGATGAATTAAAAGCTAAAGTTCTGC
AGCATATCTTGAATCCTGCTTTCTTGTACAGCTTTGAGAAGGGGGAAGGAGAGCAGCTCTTGGGACCTCCCAATC
CAGAAGGAGATAACCCAGAAAGCATCACCAGTGTGTTTATTACCAAGGTCCTGGACCCCGAGAAGCAGGCGGACA
TGCTGGACTCGCTGCGGATCTACCTGCTGCAGTACGCCACGCTGCTGGTGGAGCACGCCCCCCACCACATCCATG
ACAACAACAAGAACCGCAACAGCAAGCTGCGCCGCCTCATGACCTTCGCCTGGCCCTGCCTGCTCTCCAAGGCCT
GCGTGGACCCAGCCTGCAAGTACAGCGGACACTTGCTCCTGGCGCACATTATCGCCAAATTCGCCATACACAAGA
AGATCGTCCTGCAGGTTTTTCATAGTCTCCTCAAGGCTCACGCAATGGAAGCTCGAGCGATCGTCAGACAGGCGA
TGGCCATTCTGACCCCGGCGGTGCCGGCCAGGATGGAGGACGGGCACCAGATGCTGACCCACTGGACCCGGAAGA
TCATTGTGGAGGAGGGGCACACCGTCCCGCAGCTGGTCCACATTCTGCACCTGATAGTGCAACACTTCAAGGTGT
ACTACCCGGTACGGCACCACTTGGTGCAGCACATGGTGAGCGCCATGCAGAGGCTGGGCTTCACGCCCAGTGTCA
CCATCGAGCAGAGGCGGCTGGCCGTGGACCTGTCTGAAGTCGTCATCAAGTGGGAGCTGCAGAGGATCAAGGACC
AGCAGCCGGATTCAGATATGGACCCAAATTCCAGTGGAGAAGGAGTCAATTCTGTCTCATCCTCCATTAAGAGAG
GCCTGTCCGTGGATTCTGCCCAGGAAGTGAAACGCTTTAGGACGGCCACCGGAGCCATCAGTGCAGTCTTTGGGA
GGAGCCAGTCGCTACCTGGAGCAGACTCTCTCCTCGCCAAGCCCATTGACAAGCAGCACACAGACACTGTGGTGA
ACTTCCTTATCCGCGTGGCCTGTCAGGTTAATGACAACACCAACACAGCGGGGTCCCCTGGGGAGGTGCTCTCTC
GCCGGTGTGTGAACCTTCTGAAGACTGCGTTGCGGCCAGACATGTGGCCCAAGTCCGAACTCAAGCTGCAGTGGT
TCGACAAGCTGCTGATGACTGTGGAGCAGCCAAACCAAGTGAACTATGGGAATATCTGCACGGGCCTAGAAGTGC
TGAGCTTCCTGCTAACTGTCCTCCAGTCCCCAGCCATCCTCAGTAGCTTCAAACCTCTGCAGCGTGGAATTGCCG
CCTGCATGACATGTGGAAACACCAAGGTGTTGCGAGCCGTCCACAGCCTTCTCTCGCGCCTGATGAGCATTTTCC
CAACAGAGCCGAGTACTTCCAGTGTGGCCTCCAAATATGAAGAGCTGGAGTGCCTCTACGCAGCCGTCGGAAAGG
TCATCTATGAAGGGCTCACCAACTACGAGAAGGCCACCAATGCCAATCCCTCCCAGCTCTTCGGGACCCTTATGA
TCCTCAAGTCTGCCTGCAGCAACAACCCCAGCTACATAGACAGGCTGATCTCCGTCTTTATGCGCTCCCTGCAGA
AGATGGTCCGGGAGCATTTAAACCCTCAGGCAGCGTCAGGAAGCACCGAAGCCACCTCAGGTACAAGCGAGCTGG
TGATGCTGAGTCTGGAGCTGGTGAAGACGCGCCTGGCAGTGATGAGCATGGAGATGCGGAAGAACTTCATCCAGG
```

FIGURE 566C

```
CCATCCTGACATCCCTCATCGAAAAATCACCAGATGCCAAAATCCTCCGGGCTGTGGTCAAAATCGTGGAAGAAT
GGGTCAAGAATAACTCCCCAATGGCAGCCAATCAGACACCTACACTCCGGGAGAAGTCCATTTTGCTTGTGAAGA
TGATGACTTACATAGAAAAACGCTTTCCGGAAGACCTTGAATTAAATGCCCAGTTTTTAGATCTTGTTAACTATG
TCTACAGGGATGAGACCCTCTCTGGCAGCGAGCTGACGGCGAAACTTGAGCCTGCCTTTCTCTCTGGGCTGCGCT
GTGCCCAGCCACTCATCAGGGCAAAGTTTTTCGAGGTTTTTGACAACTCCATGAAACGTCGTGTCTACGAGCGCT
TGCTCTATGTGACCTGTTCGCAGAACTGGGAAGCCATGGGAACCACTTCTGGATCAAGCAGTGCATTGAGCTGC
TTCTGGCCGTGTGTGAGAAGAGCACCCCCATTGGCACCAGCTGCCAAGGAGCCATGCTCCCGTCCATCACCAACG
TCATCAACCTGGCCGATAGCCACGACCGTGCCGCCTCGCCATGGTCACACATGTCAAGCAGGAGCCCCGGGAGC
GGGAGAACAGCGAGTCCAAAGAGGAGGATGTAGAGATAGACATCGAACTAGCTCCTGGGGATCAGACCAGCACGC
CCAAAACCAAAGAACTTTCAGAAAAGGACATTGGAAACCAGCTGCACATGCTAACCAACAGGCACGACAAGTTTC
TGGACACTCTCCGAGAGGTGAAGACTGGAGCGCTGCTCAGCGCTTTCGTTCAGCTGTGCCACATTTCCACGACGC
TGGCAGAGAAGACGTGGGTCCAGCTTTTCCCCAGATTGTGGAAGATCCTCTCTGACAGACAGCAGCATGCACTCG
CGGGTGAGATAAGTCCATTTCTGTGCAGCGGCAGTCACCAGGTGCAGCGGGACTGCCAGCCCAGCGCGCTGAACT
GCTTTGTGGAAGCCATGTCCCAGTGCGTGCCGCCAATCCCCATCCGACCCTGCGTCCTGAAGTACCTGGGGAAGA
CACACAACCTCTGGTTCCGGTCCACGCTGATGTTGGAGCACCAGGCTTTTGAAAAGGGTCTGAGTCTTCAGATTA
AGCCGAAGCAAACAACGGAGTTTTATGAGCAGGAGAGCATCACCCCGCCGCAGCAGGAGATACTGGATTCCCTTG
CGGAGCTTTACTCCCTGTTACAAGAGGAAGATATGTGGGCTGGTCTGTGGCAGAAGCGGTGCAAGTACTCGGAGA
CAGCGACTGCGATTGCTTACGAGCAGCACGGGTTCTTTGAGCAGGCACAAGAATCCTATGAAAAGGCAATGGATA
AAGCCAAAAAGAACATGAGAGGAGTAACGCCTCCCCTGCTATTTCCCTGAATACCAGCTCTGGGAAGACCACT
GGATTCGATGCTCCAAGGAATTGAACCAGTGGGAAGCCCTGACGGAGTACGGTCAGTCCAAAGGCCACATCAACC
CCTACCTCGTCCTGGAGTGCGCCTGGCGGGTGTCCAACTGGACTGCCATGAAGGAGGCGCTGGTGCAGGTGGAAG
TGAGCTGTCCGAAGGAGATGGCCTGGAAGGTGAACATGTACCGCGGATACCTGGCCATCTGCCACCCCGAGGAGC
AGCAGCTCAGCTTCATCGAGCGCCTGGTGGAGATGGCCAGCAGCCTGGCCATCCGCGAGTGGCGGCGGCTGCCCC
ACGTAGTGTCCCACGTGCACACGCCTCTCCTACAGGCAGCCCAGCAAATCATCGAACTCCAGGAAGCTGCACAAA
TCAACGCAGGCTTACAGCCAACCAACCTGGGAAGGAACAACAGCCTGCACGACATGAAGACGGTGGTGAAGACCT
GGAGGAACCGACTGCCCATCGTGTCTGACGACTTGTCCCACTGGAGCAGCATCTTCATGTGGAGGCAGCATCATT
ACCAGGCGATTGTAACTGCCTATGAGAATAGCTCTCAGCATGATCCCAGTTCAAATAACGCTATGCTTGGGGTTC
ATGCATCAGCTTCAGCGATCATCCAGTATGGAAAAATCGCCCGGAAACAAGGACTGGTCAATGTAGCTCTGGATA
TATTAAGTCGGATTCATACTATTCCAACTGTTCCTATCGTGGATTGCTTCCAGAAGATTCGACAGCAAGTTAAAT
GCTACCTCCAGCTGGCAGGCGTCATGGGCAAAAACGAGTGCATGCAGGGCCTTGAAGTTATTGAATCTACAAATT
TAAAATACTTCACAAAAGAGATGACAGCCGAATTTTATGCACTGAAGGGAATGTTCTTGGCTCAGATCAACAAGT
CCGAGGAGGCAAACAAAGCCTTCTCTGCAGCTGTGCAGATGCACGATGTGCTGGTGAAAGCCTGGGCCATGTGGG
GCGACTACCTGGAGAACATCTTTGTGAAGGAGCGGCAGCTGCACCTGGGCGTGTCTGCCATCACCTGCTACCTGC
ACGCCTGCCGGCATCAGAACGAGAGCAAATCGAGGAAATACTTAGCCAAGGTGCTGTGGCTTTTGAGTTTTGATG
ATGACAAAAACACTTTGGCAGATGCCGTCGACAAGTACTGCATTGGTGTGCCACCCATCCAGTGGCTGGCCTGGA
TCCCACAGCTGCTCACCTGCCTGGTTGGCTCGGAGGGAAAGCTGCTCTTGAACCTCATTAGCCAGGTTGGACGCG
TGTATCCCCAAGCGGTCTACTTTCCCATCCGGACCCTGTACCTGACCCTGAAAATAGAACAGCGGGAACGCTACA
AGAGCGATCCAGGGCCCATAAGAGCAACAGCACCCATGTGGCGCTGCAGCCGAATCATGCACATGCAGCGAGAGC
TCCACCCCACCCTTCTGTCTTCCCTGGAAGGCATCGTCGATCAGATGGTCTGGTTCAGAGAAAATTGGCATGAAG
AGGTTCTCAGGCAGCTCCAACAGGGCCTGGCGAAATGTTACTCCGTGGCGTTTGAGAAAAGTGGAGCGGTGTCCG
ATGCTAAAATCACCCCCCACACTCTCAATTTTGTGAAGAAGTTGGTGAGCACGTTTGGGGTGGGCCTGGAGAATG
TGTCCAACGTCTCGACCATGTTCTCCAGCGCAGCCTCTGAGTCTCTGGCCCGGCGGGCGCAGGCCACTGCACAAG
ACCCTGTCTTTCAGAAGCTGAAAGGCCAGTTCACGACGGATTTTGACTTCAGCGTTCCAGGATCCATGAAGCTTC
ATAATCTTATTTCTAAGTTGAAAAAGTGGATCAAAATCTTGGAGGCCAAGACCAAGCAACTCCCCAAATTCTTCC
TCATAGAGGAAAAGTGCCGGTTCTTGAGCAATTTCTCGGCACAGACAGCTGAAGTGGAAATTCCTGGGGAGTTTC
TGATGCCAAAGCCAACGCATTATTACATCAAGATTGCACGGTTCATGCCCCGGGTAGAGATTGTGCAGAAGCACA
ACACCGCAGCCCGGCGGCTGTACATCCGGGACACAATGGCAAGATCTACCCATACCTCGTCATGAACGACGCCT
GCCTCACAGAGTCACGGCGAGAGGAGCGTGTGTTGCAGCTGCTGCGTCTGCTGAACCCCTGTTTGGAGAAGAGAA
```

FIGURE 566D

```
AGGAGACCACCAAGAGGCACTTGTTTTTCACAGTGCCCCGGGTTGTGGCAGTTTCCCCACAGATGCGCCTCGTGG
AGGACAACCCCTCTTCACTTTCCCTTGTGGAGATCTACAAGCAGCGCTGCGCCAAGAAGGGCATCGAGCATGACA
ACCCCATCTCCCGTTACTATGACCGGCTGGCTACGGTGCAGGCGCGGGGAACCCAAGCCAGCCACCAGGTCCTCC
GCGACATCCTCAAGGAGGTTCAGAGTAACATGGTGCCGCGCAGCATGCTCAAGGAGTGGGCGCTGCACACCTTCC
CCAATGCCACGGACTACTGGACGTTCCGGAAGATGTTCACCATCCAGCTGGCTCTGATAGGCTTCGCGGAATTCG
TCCTGCATTTAAATAGACTCAACCCCGAGATGTTACAGATCGCTCAGGACACTGGCAAACTGAATGTTGCCTACT
TTCGATTTGACATAAACGACGCGACTGGAGACCTGGATGCCAACCGTCCTGTCCCATTTCGACTCACGCCCAACA
TTTCTGAGTTTCTGACCACCATCGGGGTCTCCGGCCCGTTGACAGCGTCCATGATTGCGGTCGCCCGGTGCTTCG
CCCAGCCAAACTTTAAGGTGGATGGCATTCTGAAAACGGTTCTCCGGGACGAGATCATTGCTTGGCACAAAAAAA
CACAAGAGGACACGTCCTCTCCTCTCTCGGCCGCCGGGCAGCCAGAGAACATGGACAGCCAGCAACTGGTGTCCC
TGGTTCAGAAAGCCGTCACCGCCATCATGACCCGCCTGCACAACCTCGCCCAGTTCGAAGGCGGGGAAAGCAAGG
TGAACACCCTGGTGGCCGCGGCAAACAGCCTGGACAATCTGTGCCGCATGGACCCCGCCTGGCACCCCTGGCTGT
GACTGTGGCCGCCACGGCACGCGGGAATGTGAAGGGCGCTCCGGGCTCTGAGCCCGCAGCTTTTACGACTTCTCC
CTGCGTCGTTCCTTATATTCACAGAAGCCCCATAGTTTCACTGGGTTGCGGTTATTTTCCTGGTAGTTTGCGTGT
AAGAAAGGGAGAATATAGTTTTAGAGGAAGCTGAACTATGACGATGCTGGGCGAACGGTTTGGGAAATGGCAGAG
CTGAAACTTATTCCAAGCTTTCAAAATAATCTTTTAAGAAGCCAGGATTCTCCGGTCTGGAATTTCTGAGTGAGT
CCTTTTTTTATGGTGTCCTCCCTCTGTGAATGTACAGGCGGAACTGTACGAACAGCTCCCTTCCATCCATTTTTA
ACTCTTTCGGAAATAACACCTCACAGCAGCTTCGTGCTTTTGTACAGACCTTTGTAACAAGTGTACAGAAAACTC
ATTTGTTTGAGAAACAGGAGTTGATGAACCCATCATGCTGGTTTTTCTCTGAGCACAAAGTTTTAGGCTGTACA
CAGCCAGCCTTGGGAATCTCGTTGAGCGTTCGGCGTGGATCCACGGGGCCAGGCCACCCTGCGGGAGGCCACACG
CATCCACTTCGGATTCAGTGGGTGAAGACAGAACTCTGAGAGTCTGCAGGCGGCTCCTGTGCTTTTTATTTCTGG
CTCTTCGGATGTCTTCTAGACATTTACTATCACTGCACCTGAAGAAAAAATCACTTTTACCTTCCTAATTTAAAA
AGACAAAACAGAAATGTACGTTCCTTCGCTAGCTTTAGTCTTTCTGTTCCCATTTTTATAAATCTGAGCATTGAT
AATGTTCTATCTAAATTTGTACAGTGTGATTTTTTTT
```

FIGURE 567

MAFVATQGATVVDQTTLMKKYLQFVAALTDVNTPDETKLKMMQEVSENFENVTSSPQYSTFLEHIIPRFLTFLQD
GEVQFLQEKPAQQLRKLVLEIIHRIPTNEHLRPHTKNVLSVMFRFLETENEENVLICLRIIIELHKQFRPPITQE
IHHFLDFVKQIYKELPKVVNRYFENPQVIPENTVPPPEMVGMITTIAVKVNPEREDSETRTHSIIPRGSLSLKVL
AELPIIVVLMYQLYKLNIHNVVAEFVPLIMNTIAIQVSAQARQHKLYNKELYADFIAAQIKTLSFLAYIIRIYQE
LVTKYSQQMVKGMLQLLSNCPAETAHLRKELLIAAKHILTTELRNQFIPCMDKLFDESILIGSGYTARETLRPLA
YSTLADLVHHVRQHLPLSDLSLAVQLFAKNIDDESLPSSIQTMSCKLLLNLVDCIRSKSEQESGNGRDVLMRMLE
VFVLKFHTIARYQLSAIFKKCKPQSELGAVEAALPGVPTAPAAPGPAPSPAPVPAPPPPPPPPPATPVTPAPVP
PFEKQGEKDKEDKQTFQVTDCRSLVKTLVCGVKTITWGITSCKAPGEAQFIPNKQLQPKETQIYIKLVKYAMQAL
DIYQVQIAGNGQTYIRVANCQTVRMKEEKEVLEHFAGVFTMMNPLTFKEIFQTTVPYMVERISKNYALQIVANSF
LANPTTSALFATILVEYLLDRLPEMGSNVELSNLYLKLFKLVFGSVSLFAAENEQMLKPHLHKIVNSSMELAQTA
KEPYNYFLLLRALFRSIGGGSHDLLYQEFLPLLPNLLQGLNMLQSGLHKQHMKDLFVELCLTVPVRLSSLLPYLP
MLMDPLVSALNGSQTLVSQGLRTLELCVDNLQPDFLYDHIQPVRAELMQALWRTLRNPADSISHVAYRVLGKFGG
SNRKMLKESQKLHYVVTEVQGPSITVEFSDCKASLQLPMEKAIETALDCLKSANTEPYYRRQAWEVIKCFLVAMM
SLEDNKHALYQLLAHPNFTEKTIPNVIISHRYKAQDTPARKTFEQALTGAFMSAVIKDLRPSALPFVASLIRHYT
MVAVAQQCGPFLLPCYQVGSQPSTAMFHSEENGSKGMDPLVLIDAIAICMAYEEKELCKIGEVALAVIFDVASII
LGSKERACQLPLFSYIVERLCACCYEQAWYAKLGGVVSIKFLMERLPLTWVLQNQQTFLKALLFVMMDLTGEVSN
GAVAMAKTTLEQLLMRCATPLKDEERAEEIVAAQEKSFHHVTHDLVREVTSPNSTVRKQAMHSLQVLAQVTGKSV
TVIMEPHKEVLQDMVPPKKHLLRHQPANAQIGLMEGNTFCTTLQPRLFTMDLNVVEHKVFYTELLNLCEAEDSAL
TKLPCYKSLPSLVPLRIAALNALAACNYLPQSREKIIAALFKALNSTNSELQEAGEACMRKFLEGATIEVDQIHT
HMRPLLMMLGDYRSLTLNVVNRLTSVTRLFPNSFNDKFCDQMMQHLRKWMEVVVITHKGGQRSDGNEMKICSAII
NLFHLIPAAPQTLVKPLLEVVMKTERAMLIEAGSPFREPLIKFLTRHPSQTVELFMMEATLNDPQWSRMFMSFLK
HKDARPLRDVLAANPNRFITLLLPGGAQTAVRPGSPSTSTMRLDLQFQAIKIISIIVKNDDSWLASQHSLVSQLR
RVWVSENFQERHRKENMAATNWKEPKLLAYCLLNYCKRNYGDIELLFQLLRAFTGRFLCNMTFLKEYMEEEIPKN
YSIAQKRALFFRFVDFNDPNFGDELKAKVLQHILNPAFLYSFEKGEGEQLLGPPNPEGDNPESITSVFITKVLDP
EKQADMLDSLRIYLLQYATLLVEHAPHHIHDNNKNRNSKLRRLMTFAWPCLLSKACVDPACKYSGHLLLAHIIAK
FAIHKKIVLQVFHSLLKAHAMEARAIVRQAMAILTPAVPARMEDGHQMLTHWTRKIIVEEGHTVPQLVHILHLIV
QHFKVYYPVRHHLVQHMVSAMQRLGFTPSVTIEQRRLAVDLSEVVIKWEL

FIGURE 568

```
AACTTTAATTGCCAAGATTTCACCCCTCCTCCTCAAGCCCAGATTATTTATCCTCCCTCCGGCCTGGGCTGCTGG
ATGCAGCAGCGGCTGGGCTTGGTCCCAGGAGCAGGGAGAGTGCGCTCCCGGCCCTCCTAGCCGCGTGCCCGGGCC
ATGGTGCGGCTGAGCCCCGCGCTTGGGTGAGGCGGCGGCGCGGCTCGGAGCCCGGCGGACCGGTCCTACGGGACA
TCTTCCCCTGAGGAGGAGTCTTCCCCTGGGGCTGCGTGCCGGGGGCGAGCGGCGGCCGCGATGTTCAGCTGGCTG
GGTACGGACGACCGCCGGAGGAAGGACCCCGAGGTTTTCCAGACGGTGAGTGAGGGGCTCAAGAAACTCTACAAG
AGCAAGCTGCTGCCCTTGGAAGAGCATTACCGCTTCCACGAGTTCCACTCGCCCGCCCTGGAGGATGCCGACTTC
GACAACAAGCCCATGGTTCTGCTGGTGGGCCAGTACTCCACTGGGAAGACCACCTTCATCAGGTACCTGCTGGAA
CAGGACTTCCCAGGCATGAGGATTGGGCCTGAGCCCACCACAGACTCCTTCATTGCGGTGATGCAGGGAGACATG
GAGGGGATCATCCCTGGGAACGCCCTGGTGGTGGATCCCAAGAAACCCTTCAGGAAACTCAACGCCTTTGGCAAC
GCCTTCTTGAACAGGTTCGTGTGTGCCCAGCTACCTAACCCTGTGCTGGAGAGCATCAGCGTCATCGACACACCA
GGGATCCTCTCTGGGGAGAAGCAGAGGATCAGCCGGGGGTATGACTTTGCAGCTGTCCTTGAGTGGTTTGCCGAG
CGGGTTGACCGCATCATTCTGCTCTTCGATGCCCACAAACTGGACATCTCTGATGAGTTCTCAGAAGTCATCAAA
GCCCTCAAGAACCACGAGGACAAGATGCGAGTGGTGCTGAACAAAGCTGACCAGATCGAGACGCAGCAGCTGATG
CGGGTGTACGGGGCCCTCATGTGGTCCTTGGGGAAGATCGTGAACACCCCAGAGGTGATCCGGGTCTACATCGGC
TCCTTCTGGTCCCACCCCCTCCTCATCCCTGACAACCGGAAGCTCTTTGAGGCTGAGGAACAGGACCTATTCAGG
GACATCCAGAGTCTGCCCCGAAATGCTGCCCTGCGCAAGCTCAACGACCTCATCAAAGGGCCAGGCTGGCCAAG
GTCCACGCCTACATCATCAGCTCTCTGAAGAAGGAGATGCCCTCGGTGTTCGGGAAGGACAACAAGAAGAAGGAG
CTGGTCAACAACCTGGCCGAGATCTATGGCCGGATCGAGCGGGAGCACCAGATCTCACCTGGGGACTTCCCCAAT
CTGAAGAGGATGCAGGACCAGCTGCAGGCCCAGGACTTTAGCAAGTTCCAGCCGCTGAAGAGCAAGCTGCTGGAG
GTAGTGGACGACATGCTGGCCCATGACATTGCCCAGCTCATGGTGCTAGTGCGCCAGGAGGAGTCACAGCGGCCC
ATCCAGATGGTGAAGGGCGGAGCGTTCGAGGGCACCCTGCACGGCCCCTTTGGGCATGGCTATGGGGAGGGGGCT
GGAGAAGGTATCGATGATGCTGAGTGGGTGGTGGCCAGGGACAAGCCCATGTACGACGAGATCTTCTACACCCTG
TCACCGGTGGATGGCAAGATCACAGGCGCTAATGCCAAGAAGGAGATGGTGCGCTCCAAGCTGCCCAACAGTGTG
CTGGGCAAGATCTGGAAGCTGGCCGACATTGACAAGGATGGCATGCTGGACGACGACGAGTTTGCACTGGCCAAC
CACCTCATCAAAGTCAAGCTGGAGGGGCACGAGCTGCCCAACGAGCTGCCTGCCCACCTCCTGCCCCGTCCAAG
AGGAAAGTTGCCGAGTGATGGGGTGGGGGGACATTCAGACGGGCAGTGTTAGAGGAGGAGATGGGAGCGGTGACT
ACACACACACACACACACACACACACACACAAACATGCACACACACATATGCATATCTTGACATTGCTCTGTA
GGTGAGAGAGGACCATGACGCCCATGTTTGCAGCTGATACTTGTTTGGGCACACCTCCAAGTTCTCGGGATTAGA
AGGACAAGAGCACTCCCAGGCCCCAGAGTCTAAGCCTAAGTCTCTATCGCTCTTCCCCTCTCCTCGGCCACTCCC
CAGATACCAGACCTGAGGCAATTCACTTGCCAGCACAGATGGCCAACCCACCTCCAGATTCCCCAGTGCTTCCAC
ACCCGGGCTCTGAGCAAATGGAAAAGACTTTTCATTTAGTAGACAATTCACTTCTTTTTCTGTGCTTCCCCTATC
TGCTTTGGCTTCCTAATAAGAAATCCATTCAAGAGCTAGGAGATCTGAGGGCAGGCGGGCAGCTGCAGGGAGGAG
AGGTGAGAAAGGAAGCGTCTTCTAGAGACATTGGCCCAGGAGCTCTGTTCTTTCCTAATCTAAGCCTCTGTCTTC
TTCGGCAAACCTTGCTTTGAACTCTGCCAGTATTTCATTTTAAAGAATCCCAGAGCGGGAGAGAGAAGAGAAAAA
AATTGATAAGAGTGAGGAAATTGTCCTGTAGTCTATTGAAAACCAGTCAAGGTGGTTTTAGTTCATAGATTTTGT
TAGATGTTCTTTCCACCTGGCCTATGATGTTTAGATGTTCATACTTGACTCACATTTACCCAGCCCCTCCTGCGT
ACCAGGAGCTGTGTTAGGCACTTTATATACATTATTCTATGTGGCCCTCACTGATGCCCAGGGAAGTATGCATT
AGCCTTCCCATTTTGCAGTTGAGGAGGCTGAGTAGCCTCAGAAGGGTTTAGGCGACCTTCTGAAACTCACAGAAG
TCACGTGATGGAGAGAGGATTCAAAGCCAGGGCCTCAGACCCTCACACACTTGTCTGTGCTATGATGTATGCAGG
ATCCCAGCATTGATACCCAATGACAAACTATGGAGAACAAGCAAAGTATGCAGGCCCCTGCAGCCTCCCAGGAC
AGGCTGGCAAGGGAGGAGGGCCGGCCAGCATTTGGTGGCCCATCAGTCTGGCCATCTGTCACGTCACAGAAGCAA
ACCGTGCCTTCTGGCTCTGCGCCCCATATTCCCAGCATCATAGACATCCAACAGCACCAGCAGGAGAGTGGGCTA
GCCTGCTGGATGCTGTTCGTGCCTGTCCCTGCTCTGCCTCCCACCCAGTTGCCTGAATCATCCCAGCTCAGATGC
AGCCACTGTCTCTTGTCAAGTGGGACCTCATACTATTCTCAGAAGGCTAACTTGAGAGGTTTGGGGCCTTGTTCC
CCAGAGGGTCCCCAGGGACTCTGCAGTGTCCTTGGCAAATCCCCACTGTACTCAATGCCCTACATTCTCTTCTGT
GGTCTCTCCCCTGGCTTGCTTCATGGCCACTGAACCAATCACTTTGTATGCTATGCTCCTACTGTGATGGAAAAC
AAAATGAGTATAACTTATTTTATATCCATATTCAGACTATATAGAGAATATTCTATGCATCTATGACGTGCTTAC
TACTGCAGTGCATTTGTCATTAGTCTTCATGTTAATACAGTACATTTATTCTTTGGTA
```

FIGURE 569

MFSWLGTDDRRRKDPEVFQTVSEGLKKLYKSKLLPLEEHYRFHEFHSPALEDADFDNKPMVLLVGQYSTGKTTFI
RYLLEQDFPGMRIGPEPTTDSFIAVMQGDMEGIIPGNALVVDPKKPFRKLNAFGNAFLNRFVCAQLPNPVLESIS
VIDTPGILSGEKQRISRGYDFAAVLEWFAERVDRITLLFDAHKLDISDEFSEVIKALKNHEDKMRVVLNKADQIE
TQQLMRVYGALMWSLGKIVNTPEVIRVYIGSFWSHPLLIPDNRKLFEAEEQDLFRDIQSLPRNAALRKLNDLIKR
ARLAKVHAYIISSLKKEMPSVFGKDNKKKELVNNLAEIYGRIEREHQISPGDFPNLKRMQDQLQAQDFSKFQPLK
SKLLEVVDDMLAHDIAQLMVLVRQEESQRPIQMVKGGAFEGTLHGPFGHGYGEGAGEGIDDAEWVVARDKPMYDE
IFYTLSPVDGKITGANAKKEMVRSKLPNSVLGKIWKLADIDKDGMLDDDEFALANHLIKVKLEGHELPNELPAHL
LPPSKRKVAE

FIGURE 570

```
CGCGCCTCGGGCGGTACCCAGCCAGTCCCCAGCGCCGCGCTACCGCGCTGACCGGCCCTCCAGACGCCTCCCGGT
ACCCGGGACCCCAGCCCGGCCGCTCGCCCGCAGCCCGCCGGCCGCACACGTCCCCGGAGCCGGGCCTAGGGCGGG
CGGCAGCGGCGGCTCGGCGCAGTCAGGCTGGGCTCTGTAGCGTCCCCATGGCCGCGGCCGGCTGGCGGGACGGCT
CCGGCCAGGAGAAGTACCGGCTCGTGGTGGTCGGCGGGGCGGCGTGGGCAAGTCGGCGCTCACCATCCAGTTCA
TCCAGTCCTATTTTGTAACGGATTATGATCCAACCATTGAAGATTCTTACACAAAGCAGTGTGTGATAGATGACA
GAGCAGCCCGGCTAGATATTTTGGATACAGCAGGACAAGAAGAGTTTGGAGCCATGAGAGAACAGTATATGAGGA
CTGGCGAAGGCTTCCTGTTGGTCTTTTCAGTCACAGATAGAGGCAGTTTTGAAGAAATCTATAAGTTTCAAAGAC
AGATTCTCAGAGTAAAGGATCGTGATGAGTTCCCAATGATTTTAATTGGTAATAAAGCAGATCTGGATCATCAAA
GACAGGTAACACAGGAAGAAGGACAACAGTTAGCACGGCAGCTTAAGGTAACATACATGGAGGCATCAGCAAAGA
TTAGGATGAATGTAGATCAAGCTTTCCATGAACTTGTCCGGGTTATCAGGAAATTTCAAGAGCAGGAATGTCCTC
CTTCACCAGAACCAACACGGAAAGAAAAAGACAAGAAAGGCTGCCATTGTGTCATTTCTAGAATCCCTTCAGTT
TTAGCTACCAACGGCCAGGAAAAGCCCTCATCTTCTCTTTCTCTCCTCAGTTTACATCTTGTTGGTACCTTTCTA
GCCTTAGACAAATGATCACCATGTTAGCCTTAGACCAAGAAGCTGGCTAGTCCTTTCTGTGAAGCTAATACAATG
GTCATTTCCAGACAAATTTAAAGGAAACACTAAGGCTGCTTCAAAGATTATCTGATTCCTTTAAAATATATGTCT
ATATACACAGACATGCTCTTTTTTTAAGTGCTTACATTTTAATAGAGATGAATCAGTTTTGGAATCTAAGCTGTT
TGCCAAGCTGAAGCTACAGGTTGTGAAATAATTTTTAACTTTTGGAATCATACTGCCTACTGTTACTCTAAATAG
AAATATAGGGTTTTTTTTAATGTGAATTTTTGCCTATCTTTAAACATTTCAATGTCAGCCTTTGTTAACCTTAAA
TACACTGAATTGAATCTACAAAAGTGAACCATCTCAGACCTTTACTGATACTACAACTTTTGTTTTCTGATGGCC
AAAATACCAAATGCCTGTTGTATTTATGGATTAAAAACTGCTTATAAAAAAAAAAAAAAAA
```

FIGURE 571

MAAAGWRDGSGQEKYRLVVVGGGGVGKSALTIQFIQSYFVTDYDPTIEDSYIKQCVIDDRAARLDILDTAGQEEF
GAMREQYMRTGEGFLLVFSVTDRGSFEEIYKFQRQILRVKDRDEFPMILIGNKADLDHQRQVTQEEGQQLARQLK
VTYMEASAKIRMNVDQAFHELVRVIRKFQEQECPPSPEPTRKEKDKKGCHCVIF

FIGURE 572

```
TTTGCTTCGAGATGGCTGCGGGGATGTATTTGGAACATTATCTGGACAGTATTGAAAACCTTCCCTTTGAATTAC
AGAGAAACTTTCAGCTCATGAGGGACCTAGACCAAAGAACAGAGGACCTGAAGGCTGAAATTGACAAGTTGGCCA
CTGAGTATATGAGTAGTGCCCGCAGCCTGAGCTCCGAGGAAAAATTGGCCCTTCTCAAACAGATCCAGGAAGCCT
ATGGCAAGTGCAAGGAATTTGGTGACGACAAGGTGCANCTTGCCATGCAGACCTATGAGATGGTGGACAAACACA
TTCGGCGGCTGGACACAGACCTGGCCCGTTTTGAGGCTGATCTCAAGGAGAAACAGATTGAGTCAAGTGACTATG
ACAGCTCTTCCAGCAAAGGCAAAAAGAGCCGGACTCAAAAGGAGAAGAAAGCTGCTCGTGCTCGTTCCAAAGGGA
AAAACTCGGATGAAGAAGCCCCCAAGACTGCCCAGAAGAAGTTAAAGCTCGTGCGCACAAGTCCTGAGTATGGGA
TGCCCTCAGTGACCTTTGGCAGTGTCCACCCCTCTGATGTGTTGGATATGCCTGTGGATCCCAACGAACCCACCT
ATTGCCTTTGTCACCAGGTCTCCTATGGAGAGATGATTGGCTGTGACAACCCTGATTGTTCCATTGAGTGGTTCC
ATTTTGCCTGTGTGGGGCTGACAACCAAGCCTCGGGGGAAATGGTTTTGCCCACGCTGCTCCCAAGAACGGAAGA
AGAAATAGATAAGGGCCTTGGATTCCAACACAGTTTCTTCCACATCCCCTGACTTGGGCTAGTGGGCAGAGGAAT
GCCTGTGCTGGGGCCAGGGGTTCAGGGAGGAGTGGATGGCACAGTGCTGTCATCCCTTCTCCTCCCCTCTCCCCA
CTCCCGGTGCTGAGGCTGCATCAGACCCTGGTAGGGAGGGGTGCCGCAGCCACTAACGAGACACTGTTTTAGTAA
ACATGCTGAGCATTCATTTTGCGTCCTCTGGGTTGGATGCGATGTGAGAGGATGGCATGCCAGAATTAGGACACG
ACATGAAACCAGAGTGGTGCCTCTGTCCGAGAACTTGGTCTCACTTTGTCACCCAGGCTGGAGCACAGTGGTGAG
ATCTCAGCTCACTGCAGCCTTGACCTCTGAAGACTCAGTGCTGCTCCTGCCTCTGGCACCTGCCGCAGCCCAGGA
TTCGACTCAGGCCTCCACTCCAGGCAGCCCTCTCTCTCCTACCGAATACGAACGCTTCTTCGCACTGCTGACTCC
AACCTGGAAGGCAGAGACTACCTGCCGTCTCCGTGCAACCCACGGCTGCCGGAATCCCACACTCGTCCAGCTGGA
CCAATATGAAAACCACGGCTTAGTGCCCGATGGTGCTGTCTGCTCCAACCTCCCTTATGCCTCCTGGTTTGAGTC
TTTCTGCCAGTTCACTCACTACCGTTGCTCCAACCACGTCTACTATGCCAAGAGAGTCCTGTGTTCCCAGCCAGT
CTCTATTCTCTCACCTAACACTCTCAAGGAGATAGAAGCTTCAGCTGAAGTCTCACCCACCACGATGACCTCCCC
CATCTCACCCCACTTCACAGTGACAGAACNCCAGACCTTCCAGCCCTGGCCTGAGAGGCTCAGCAACAACGTGGA
AGAGCTCCTACAATCCTCCTTGTCCCTGGGAGGCCAGGAGCAAGCGCCAGAGCACAAXXXXXXXXXXXXXXXXXX
XXXXXXXXXXXXXXXXXXXXXXXATGATAATGGAGAACATCCAGGAGCTCATTCGATCAGCCCAGGAAATAGA
TGAAATGAATGAAATATATGATGAGAACTCNTACTGGAGAAACCAAAACCNTGGCAGCCTCNTGCAGCTGCCCCA
CACAGAGNCCNTGNTGGTGCTGTGCTATTCGATCGTGGAGAATACCTGCATCATAACCCCCACAGCCAAGGCCTG
GAAGTACATGGAGGAGGAGATCCTTGGTTTCGGGAAGTCGGTCTGTGACAGCCTTGGGCGGCGACACATGTCTAC
CTGTGCCCTCTGTGACTTCTGCTCCTTGAAGCTGGAGCAGTGCCACTCAGAGGCCAGCCTGCAGCGGCAACAATG
CGACACCTCCCACAAGACTCCCTTTGTCAGCCCCTTGCTTGCCTCCCAGAGCCTGTCCATCGGCAACCAGGTAGG
GTCCCCAGAATCAGGCCGCTTTTACGGGCTGGATTTGTACGGTGGGCTCCACATGGACTTCTGGTGTGCCCGGCT
TGCCACGAAAGGCTGTGAAGATGTCCGAGTCTCTGGGTGGCTCCAGACTGAGTTCCTTAGCTTCCAGGATGGGGA
TTTCCCTACCAAGATTTGTGACACAGACTATATCCAGTACCCAAACTACTGTTCCTCAAAAGCCAGCAGTGTCT
GATGAGAAACCGCAATCGGAAGGTGAGCACCCCTGCCCTGCCCCTCCTTCTCCCAGCACCCCCTCAATCAGTCAC
CATAACTGGTCTATTCTGAGGCCCCCTCTGCGAGCAGCTAGGATGTGGAAAGCGGTTCCTGCTTGCATCTCTGGG
GCAGAGGCCTCCACCAGCAGGCTCTCCTCCATTCCTCCAGTCCTGGCGGAAGCAAGGCCCTCCTAGGCAGCTGGT
GGATAACAGAGGAGGGTCCTAAGAGCACCACAGGAAGAACCCTTGGCTGGGCCAGGACTTGGACGTTGAGGTCTC
GGTCTGTCTCCTCTTCTTACTCACCAAGTAGCCTGGGATGAGGCACTTCCCCCTCTGAGCCTCAGCCGCCTGTTT
CTGCATGAAAGGGGTTGGGCTGCTTGATGTCTCCTCTGGCTTTAAAAACCCACATTTGAGTTTCCTCCTTCCCTC
TACTGCCCTGTGCCCATGCCTGCCCACCTCTCGTTCTTTTGGGCTTCTGACACCTCCCCTCCTCCCCACTCCTGG
CACCTGGCTCTGTGATACAGACCGTCTGCACTGAATCTGTGTGTAGGTGTCCCGCATGAGATGTCTGCAGAATGA
GACTTACAGTGCGCTGAGCCCTGGCAAAAGTGAGGACGTTGTGCTTCGATGGAGCCAGGAGTTCAGCACCTTGAC
TCTAGGCCAGTTCGGATGAGCTGGCGTCTATTCTGCCCACACCCCAGCCCAACCTGCCCACGTTCTCTATTGTTT
TGAGACCCCATTGCTTTCAGGCTGCCCCTTNTGGGTCTGTTACTCGGCCCCTACTCACATTTCCTTGGGTTGGAG
CAACAGTCCCAGAGAGGGCCATGGTGGGAGCTGCGCCCTCCTTAAAAGATGACTTTACATAAAATGTTGATCTTC
AGCCAA
```

FIGURE 573

MAAGMYLEHYLDSIENLPFELQRNFQLMRDLDQRTEDLKAEIDKLATEYMSSARSLSSEEKLALLKQIQEAYGKC
KEFGDDKVXLAMQTYEMVDKHIRRLDTDLARFEADLKEKQIESSDYDSSSSKGKKSRTQKEKKAARARSKGKNSD
EEAPKTAQKKLKLVRTSPEYGMPSVTFGSVHPSDVLDMPVDPNEPTYCLCHQVSYGEMIGCDNPDCSIEWFHFAC
VGLTTKPRGKWFCPRCSQERKKK

FIGURE 574

CCCACAGACTCAGAGAGAACCCACCATGGTGCTGTCTCCTGACGACAAGACCAACGTCAAGGCCGCCTGGGGTAA
GGTCGGCGCGCACGCTGGCGAGTATGGTGCGGAGGCCCTGGAGAGGATGTTCCTGTCCTTCCCCACCACCAAGAC
CTACTTCCCGCACTTCGACCTGAGCCACGGCTCTGCCCAGGTTAAGGGCCACGGCAAGAAGGTGGCCGACGCGCT
GACCAACGCCGTGGCGCACGTGGACGACATGCCCAACGCGCTGTCCGCCCTGAGCGACCTGCACGCGCACAAGCT
TCGGGTGGACCCGGTCAACTTCAAGCTCCTAAGCCACTGCCTGCTGGTGACCCTGGCCGCCCACCTCCCCGCCGA
GTTCACCCCTGCGGTGCACGCCTCCCTGGACAAGTTCCTGGCTTCTGTGAGCACCGTGCTGACCTCCAAATACCG
TTAAGCTGGAGCCTCGGTGGCCATGCTTCTTGCCCCTTTGG

FIGURE 575

MVLSPDDKTNVKAAWGKVGAHAGEYGAEALERMFLSFPTTKTYFPHFDLSHGSAQVKGHGKKVADALTNAVAHVD
DMPNALSALSDLHAHKLRVDPVNFKLLSHCLLVTLAAHLPAEFTPAVHASLDKFLASVSTVLTSKYR

FIGURE 576

```
AGAGAGGAGCCGACTCGGCAGGGACTGGGGGACCGGGCCGAGAGTGCGAGCGAGCGAGGGAGGGAGTGAGGGAGC
GTGCGAGCCAGAAGGGGAAAGGCGGCCACTCGTGCCTGAGCGACCGCAGAGGGGAGTGGGAGCAGTGGGGTAAAG
GAGCGGGGGGCGGGAATAAGAAAGGCCGAGAGAAGGCGGACAGAGGCTAGTGGTGGTGGTGGTAGGGGGAGA
AGGAGGAGCTGGAGGAGGGCAGGGGCTGAGGGAGTGAGTGAAGCGGACGCGCGAGGGAGGGGAGGGAAGGGAAGG
GAAGGGAAGGGGGGGTCACGCGGGGGCGCGCGCGCGCACCGGGAGCGCGCTCGGAGGCGAGTGGAACTGGATCGG
GTTTGCTGCCAGCGGCGTGAGCTTCGGCCGCCATTTTACAACAGCTCCACTCGCGCCGGACACAGGGAGCAGCGA
GCACGCGTTTCCCGCAACCCGATACCATCGGACAGGATTTCTCCGCCTCAGCCCAACGGGGAGATCTCTGGAAAC
ATGGCTACAGAACATGTTAATGGAAATGGTACTGAAGAGCCCATGGATACTACTTCTGCAGTTATCCATTCAGAA
AATTTTCAGACATTGCTTGATGCTGGTTTACCACAGAAAGTTGCTGAAAAACTAGATGAAATTTACGTTGCAGGG
CTAGTTGCACATAGTGATTTAGATGAAAGAGCTATTGAAGCTTTAAAAGAATTCAATGAAGACGGTGCATTGGCA
GTTCTTCAACAGTTTAAAGACAGTGATCTCTCTCATGTTCAGAACAAAAGTGCCTTTTTATGTGGAGTCATGAAG
ACTTACAGGCAGAGAGAAAAACAAGGGACCAAAGTAGCAGATTCTAGTAAAGGACCAGATGAGGCAAAAATTAAG
GCACTCTTGGAAAGAACAGGCTACACACTTGATGTGACCACTGGACAGAGGAAGTATGGAGGACCACCTCCAGAT
TCCGTTTATTCAGGTCAGGAGCCTTCTGTTGGCACTGAGATATTTGTGGGAAAGATCCCAAGAGATCTATTTGAG
GATGAACTTGTTCCATTATTTGAGAAAGCTGGACCTATATGGGATCTTCGTCTAATGATGGATCCACTCACTGGT
CTCAATAGAGGTTATGCGTTTGTCACTTTTTGTACAAAAGAAGCAGCTCAGGAGGCTGTTAAACTGTATAATAAT
CATGAAATTCGTTCTGGAAAACATATTGGTGTCTGCATCTCAGTTGCCAACAATAGGCTTTTGTGGGCTCTATT
CCTAAGAGTAAAACCAAGGAACAGATTCTTGAAGAATTTAGCAAAGTAACAGAGGGTCTTACAGACGTCATTTA
TACCACCAACCGGATGACAAGAAAAAAAACAGGAGCTTTTGCTTTCTTGAATATGAAGATCACAAAACAGCTGCC
CAGGCAAGGCGTAGGTTAATGAGTGGTAAAGTCAAGGTCTGGGGGAATGTTGGAACTGTTGAATGGGCTGATCCT
ATAGAAGATCCTGATCCTGAGGTTATGGCAAAGGTAAAAGTGCTGTTTGTACGCAACCTTGCCAATACTGTAACA
GAAGAGATTTTAGAAAAGGCATTTAGTCAGTTTGGGAAACTGGAACGAGTGAAGAAGTTAAAAGATTATGCGTTC
ATTCATTTTGATGAGCGAGATGGTGCTGTCAAGGCTATGGAAGAAATGAATGGCAAAGACTTGGAGGGAGAAAT
ATTGAAATTGTTTTTGCCAAGCCACCAGATCAGAAAAGGAAAGAAAGAAAAGCTCAGAGGCAAGCAGCAAAAAAT
CAAATGTATGACGATTACTACTATTATGGTCCACCTCATATGCCCCCTCCAACAAGAGGTCGAGGGCGTGGAGGT
AGAGGTGGTTATGGATATCCTCCAGATTATTATGGATATGAAGATTATTATGATTATTATGGTTATGATTACCAT
AACTATCGTGGTGGATATGAAGATCCATACTATGGTTATGAAGATTTTCAAGTTGGAGCTAGAGGAAGGGGTGGT
AGAGGAGCAAGGGGTGCTGCTCCATCCAGAGGTCGTGGGGCTGCTCCTCCCCGCGGTAGAGCCGGTTATTCACAG
AGAGGAGGTCCTGGATCAGCAAGAGGCGTTCGAGGTGCGAGAGGAGGTGCCCAACAACAAAGAGGCCGCGGGGTA
CGTGGTGCGAGGGGTGGCCGCGGTGGAAATGTAGGAGGAAAGCGCAAAGCTGATGGGTACAACCAGCCAGATCC
AAGCGGCGCCAGACCAATAATCAGAACTGGGGCTCCCAACCCATTGCTCAGCAACCGCTCCAAGGTGGTGATCAT
TCTGGTAACTATGGTTACAAATCTGAAAACCAGGAGTTTTATCAGGATACTTTTGGGCAACAGTGGAAGTAGAAA
CAGTAGGGCCTCTGTAAAATTGGAGACTGATAGGTTGATCAGAAACTCACCCTAAATCTGAACGGGTGCCGCTAT
AATTTGTGACATCTGGCAAGATTTCCCTTTATGTATATATTTTAACAATCCGCTTGGACACGAACAAAGCCACAC
TTCTAACTGCTTCTGGCGAACTGATTTTATTTTTAATTTTTTTCAATAAAGATATTCTTAGATACTGAAAGAAAT
AGTTAATGAGTTTGCATTTGTGCTTGAGAAAATTTGGCTCAAGTCCATTTGGCTGTAGTGTCAACGATGTTTCCA
GTAGTGTTTAGATTTGGTGTCTTCAAAGGTAGTTGATTAAAACCAAGTGTGTCTTTAATATCTTGTATCAGAATA
ACTTGTATGTTACCAACTTAAATTGCTAGAATAAGGTAAATTGATACACAACTGCTATTTTAATTTAGAACTT
TGACCTAATTTGGGTTTTCAAAACCATTTTGGCTACTTGTATTCTTTATGCTGTTGTTTATTTCAATAAAAAATT
CACACCT
```

FIGURE 577

MATEHVNGNGTEEPMDTTSAVIHSENFQTLLDAGLPQKVAEKLDEIYVAGLVAHSDLDERAIEALKEFNEDGALA
VLQQFKDSDLSHVQNKSAFLCGVMKTYRQREKQGTKVADSSKGPDEAKIKALLERTGYTLDVTTGQRKYGGPPPD
SVYSGQQPSVGTEIFVGKIPRDLFEDELVPLFEKAGPIWDLRLMMDPLTGLNRGYAFVTFCTKEAAQEAVKLYNN
HEIRSGKHIGVCISVANNRLFVGSIPKSKTKEQILEEFSKVTEGLTDVILYHQPDDKKKNRSFCFLEYEDHKTAA
QARRRLMSGKVKVWGNVGTVEWADPIEDPDPEVMAKVKVLFVRNLANTVTEEILEKAFSQFGKLERVKKLKDYAF
IHFDERDGAVKAMEEMNGKDLEGENIEIVFAKPPDQKRKERKAQRQAAKNQMYDDYYYYGPPHMPPPTRGRGRGG
RGGYGYPPDYYGYEDYYDYYGYDYHNYRGGYEDPYYGYEDFQVGARGRGGRGARGAAPSRGRGAAPPRGRAGYSQ
RGGPGSARGVRGARGGAQQQRGRGVRGARGGRGGNVGGKRKADGYNQPDSKRRQTNNQNWGSQPIAQQPLQGGDH
SGNYGYKSENQEFYQDTFGQQWK

FIGURE 578

```
AATTATGGCGACCTCCGCGACGTCGCCGCACGCGCCTGGTTTTCCAGCTGAGGGTAGATGCGGTTACTATGTGGA
AAAGAAGAAACGGTTCTGCAGGATGGTGGTGGCCGCAGGGAAAAGATTTTGTGGTGAACACGCTGGAGCCGCGGA
GGAAGAAGATGCTCGGAAAAGAATCCTGTGTCCTTTAGATCCAAAACACACAGTATATGAAGATCAACTAGCAAA
GCATTTGAAAAAATGTAACTCAAGAGAGAAACCAAAACCTGATTTCTATATTCAAGATATTAATGCAGGCTTAAG
AGATGAAACAGAAATACCTGAACAATTAGTTCCAATTTCTTCTCTATCTGAAGAGCAGTTGGAAAAGTTAATTAA
GAAATTGAGAAAAGCAAGTGAAGGCTTGAATTCTACACTTAAAGATCATATTATGTCCCATCCAGCATTACACGA
TGCACTTAATGACCCTAAAAATGGCGATTCTGCAACCAAGCACCTGAAACAGCAGGTATGTTTAGGCTATAGTAA
CTACTAAACATGGCCTTTGTTCATTTGTTAAAACTGTTTTAAATGTAATTATTAATAAGATTTTATTTTGTTTAC
CTTTGAGGGTACCAAATATTTCCATTTCAAAAATATATAGAAACATATACAAAAAATTGAGGGCATGGATGTGAT
TCTGAGTACCGTATATTAAATATTTAAAGGCAAGAGAGAAAAATTTTAAGTCAAATACAAATTATCAATGTAAGC
ATACTGCCTTATGCAGAAATTACCTTGCTGTTTTCCCATTTGAACCAAATGTGTTTACTCTAGTTTATAAAATAA
TCTTGTGAAGTTTGCAGGCTTCTATTTTAGGTAACATTGAAAATTTAAAGTTACTTGGTCCAAGAAGATGCTTTG
TTGAGTTTGGAGCGGGAAAGGGAAAATTATCTCATTGGGTTGATATTGCCTTAAAAGATGCTGAAAAAGTTCACT
TCATCCTAGTGGAAAAGGTGACCACAAGATTCAAGGTGGATGGAAAACACAGAAAGAAAAATTCAGTGTTTGAAA
GACTTCAAATTGATATTCAACACTTGTGTTTGAACAAGATTCCTGTGTTAAGAGAAGAAAAACTACCTGTGGTAG
GAATTGGAAAGCATCTGTGTGGTATGGCAACAGGTACGTAAACATACTGATAATGTTTACATTAATGCATTAAGT
TTTGGCCTAACCTGGCCCCAACCATTTCAGTGGTCTCTTTTGAATAGATATCTTATGTTTACAACTCAATAATCT
TTATAGAGCACTGGCCCTGTGCTTTATTAGATGCATAGCTTTCCTATTTATCTGCTCATATTGGCCATTTGCAG
GATGAATTAAGAGTTTTGTATGTAAATACTGCATCACATTAGACCTTAAAGTTCTTTGGGTTAAATTTCAACCAG
AAAAGGAAAATAAGACCATTTATGGAAACTGTATGATTCCACCTAGAAGCTACTGATTTTTTAGAGTAGTTGCTT
AGAAAGAACTCAGAAACCTCTTCTACTAAAAGACTATTGTGTTTCAGGATTCTGGGGAAAAAGAAAAAAATAAAT
GTTAGAC
```

FIGURE 579

MATSATSPHAPGFPAEGRCGYYVEKKKRFCRMVVAAGKRFCGEHAGAAEEEDARKRILCPLDPKHTVYEDQLAKH
LKKCNSREKPKPDFYIQDINAGLRDETEIPEQLVPISSLSEEQLEKLIKKLRKASEGLNSTLKDHIMSHPALHDA
LNDPKNGDSATKHLKQQVCLGYSNY

FIGURE 580

```
GCCTTTCTGGGAAATCATTTCAGTCCACACCAACCATATTATTCAGGGTTCCTGCCATATGTGTGGGGTATCCTA
CTGATACACACGTATTCAAAGTTTATGGGTACAACAAAGACATAGTACATGTACATAATATGTATGTGAATATAG
TTAAATATATTTCTTCACAATATTTTAAACTGTGAAGAACTTTATCATACAGGAAACTTAAAACAAGAGGTGTCA
AAAGACCCAAATTAGGTGCATTTTACTTGTTTATGATGGCATAACCATTGCTTTAAAATGTTTAGACAGTAGAAT
ATTGAATTTATGCTCTATTTTTGTTTATTTAAGCAACACTTAATGTAAAAGTGCAACAGGCAATTGAATCCAAAT
TTCAACGACAAAAAAAAAACATGTATTTTAGAGTTCATCTTTGGCAAAATCTTTGGTTCAGGGTACTAGTTGTTT
AAAAGTTGATTCATATTCTTACCTTGTGCTGAGAAAGGTTGCATTGCTGCCCCTTATACACATGCTGCAGCTTGA
TGTTAAAGAATTTTTATTCTTTCTGAAGAACTAATTAATGTTTAAAGCAACTGTTTAATATGATGGCATGTGTGT
GTGTGCGTGCGTGTGTATGTTCTGAGTCCACTTCTTTTTTCCTAAATAACACTACAGGGATTTTGTCATATTAGA
TTTAATTTATAATTTGAAAAATCATCTAGTGTGTGACCTACAGGCTTAGAAATGGTATAGTCAAAGACATTTTAT
CCACATTTCTAATAGTGGACTTGATTAAGTAGATAAGATCAGCATCTGTTTATGGTAGTAGGAGAAATAGCCAAA
GTTGAGGATTTTATGTATGTTTTCCTGTTTACCTGGAAAATAGCAATTAATTGGATTTTTGGTAAAGATTGCCT
TCTGTATAATGTTTGGATTATATAAAATTGCAAAAATGATAACAGCCCGCTTTACTGTACTAAGCCTGTTACTTT
CATGACGTGTGAGCAGAATGCCTTATTTTGTAATCTTGTTTAACTTGTTGCTACTGGGACTTGATTTACTGTGGC
ACTAGTTAAGTAAGTTAAAAAAAAAGTTAAACCCTCTCATTATTAAAGAGGAAAGGCGATGGTGATGTCTGTAGTA
CAATATAAACCATAATTGTGATTTACCTTAAGTAGGTATAACTCTTATGGGATATACAGTATAGTTTTGTGAAT
CTTTACATGATAGCATTATCTTTTATAATTTTTTTCCTAAGATAAACAAATGCATAGTTTCTTCTATGGGTG
ATAGAAACAGCTTTTTGAAGTAATGAAAACCTCAAAAGATCATGTTGATTCTTAATTTTTGCCTTTTGCATAAGC
CTCTTTATAACATGTATCTTTAAAACAATTAAGTCTTTAGGAATGTGTAACCAGAACTATGTTAGTATTGCTTAT
AAAACTTTAGTTAGGTTCAATATATACATATATACATCTCTATATAGGTATATAGATTTGCATTTGTCTTGTAA
AATTTTATTTGAATAAATTCTTCCTGTAGGTAATGGGAAACAAAATTAATAGTTCATATGTCACTCATAGCATTT
CTATATTTGAAAGTAGCCCAATATAAAACTTTTGATTCTAAAATTAAACCAGCAGCCTATTACAAGCACATTCTT
TGATTGAGTCATTGGTTATAAACTTACTAAATGCAGAGAAAGCAGCCAATTTAGGAAACTTCTGAGTTGGTGGGA
CACTGTTGATTAATAATGTACTGTATGAATTAAGTGATGCTTTAACTTTGATTTTACATTTTAAAGTTAAAATGT
GGGCATTATGTCAGCAAACTTAAGGGCATTATGTCAGCAAGCTAAAACATTTTTTTTCCTGTGCTTTTAATGTAT
CTCTTTACATGATCTGAGAGAGGATTCAAGTTGATAGAAATAGCTGAGGGGAAAAGGGGGAACATCTTGGGATGA
AGCTTGTCCTTATGGTGATGGTTTAATTACAGATTAAAAAATTAGAAGGAAATTTCAGTGGATTAAGTGTATAGC
TTTCATATCTACATTTCAAGAAATTACCATTGTAACTTGATAAGAGATGATTTATTTTATGTAAACATCTTTGCA
AAGCAAGGTGTAGCAGCTCAGCTAGATTTATTACTGTGCACGAAAGTAAATACCTATCTCAATTATTCTTTTTCT
TTTCCAATATAAAGTTTGCTGAATGTACAAGAAGAGTTTATCACTTAGGATATAGAATTTTTTAGGGGTTGGGG
GAGGGGATCTGTTAGGAAACTGTTACCTATAAACAAAGATTGACTGGATTCGATCCAAAAGATAAAACTTGAAGC
TATTCTGGAACTAACATGGAAAAATGAAATGGCTATTGTTTAAAAAAATGATAGAAATACATTGTTGATGGGATA
TGAGTTAAGTTTATTTTCTACAAACTGTAATTGATGAGGACATGGATAATATCTTCATGTTTCTGAGAAGTAATC
TGTATGTGGGGGAGGGGATAATAAATATTTCTACCCCCCCAAAAAAAAAAAAAAAAAAAAAAAAAAAAAAAAAAA
AAA
```

FIGURE 581

ACACTCGCTTCTGGAACGTCTGAGATTATCAATAAGCTCCTAGTCCAGACGCCATGGGTCATTTCACAGAGGAGG
ACAAGGCTACTATCACAAGCCTGTGGGCAAGGTGAATGTGGAAGATGCTGGAGGAGAAACCCTGGGAAGGCTCC
TGGTTGTCTACCCATGGACCCAGAGGTTCTTTGACAGCTTTGGCAACCTGTCCTCTGCCTCTGCCATCATGGGCA
ACCCCAAAGTCAAGGCACATGGCAAGAAGGTGCTGACTTCCTTGGGAGATGCCATAAAGCACCTGGATGATCTCA
AGGGCACCTTTGCCCAGCTGAGTGAACTGCACTGTGACAAGCTGCATGTGGATCCTGAGAACTTCAAGCTCCTGG
GAAATGTGCTGGTGACCGTTTTGGCAATCCATTTCGGCAAAGAATTCACCCCTGAGGTGCAGGCTTCCTGGCAGA
AGATGGTGACTGCAGTGGCCAGTGCCCTGTCCTCCAGATACCACTGAGCCTCTTGCCCATGATTCAGAGCTTTCA
AGGATAGGCTTTATTCTGCAAGCAATACAAATAATAAATCTATTCTGCTGAGAGATCAC

FIGURE 582

MGHFTEEDKATITSLWGKVNVEDAGGETLGRLLVVYPWTQRFFDSFGNLSSASAIMGNPKVKAHGKKVLTSLGDA
IKHLDDLKGTFAQLSELHCDKLHVDPENFKLLGNVLVTVLAIHFGKEFTPEVQASWQKMVTAVASALSSRYH

FIGURE 583A

```
ATGCCCGGGCCCCGAGGGGCTGCTGGCGGCCTGGCCCCTGAGATGCGCGGGGCGGGGCGGCGGGGCTGCTGGCG
CTGCTGCTGCTGCTGCTGCTGCTGCTGGGCCTGGGCGGCAGGGTCGAGGGGGGGCCGGCCGGCGAGCGGGGC
GCAGGCGGGGCGGGGCGCTGGCCCGCGAGCGCTTCAAGGTGGTCTTTGCGCCGGTGATCTGCAAGCGGACCTGT
CTCAAGGGCCAGTGTCGGGACAGTTGTCAGCAGGGCTCCAACATGACGCTCATCGGAGAGAACGGCCACAGCACA
GACACGCTCACGGGCTCCGGCTTCCGCGTGGTGGTGTGCCCTCTCCCCTGCATGAATGGCGGCCAGTGCTCCTCG
CGAAACCAGTGCCTGTGTCCCCCGGACTTCACTGGGCGCTTCTGCCAGGTGCCCGCAGGAGGAGCCGGTGGGGGT
ACCGGCGGCTCAGGCCCCGGCCTGAGCAGGACAGGGCCCTGTCCACAGGGGCGCTGCCGCCCCTGGCTCCGGAG
GGCGACTCTGTGGCCAGCAAGCACGCCATCTACGCCGTCCAGGTGATCGCTGACCCTCCTGGGCCCGGGGAGGGG
CCTCCTGCCCAGCACGCAGCCTTCCTGGTGCCCCTAGGCCCGGGACAGATCTCAGCAGAAGTGCAGGCCCCGCCC
CCCGTGGTGAATGTGCGCGTCCATCACCCGCCCGAGGCCTCAGTCCAGGTGCACCGCATTGAGAGCTCGAACGCC
GAGAGCGCAGCCCCCTCCCAGCACCTGCTGCCGCACCCCAAGCCCTCGCACCCCGGCCGCCCACCCAGAAGCCC
CTGGGCCGCTGCTTTCAGGACACTCTGCCCAAGCAGCCGTGTGGCAGCAACCCCCTCCCCGGCCTCACCAAGCAG
GAAGACTGCTGCGGTAGCATCGGCACTGCCTGGGGCCAGAGCAAGTGCCACAAGTGTCCCCAGCTGCAGTACACA
GGAGTGCAGAAGCCAGGGCCTGTACGTGGGGAAGTGGGCGCTGACTGTCCCCAGGGCTACAAGAGGCTTAACAGC
ACCCACTGCCAGGACATCAACGAGTGCGCAATGCCGGGCGTGTGTCGCCATGGTGACTGCCTCAACAACCCTGGC
TCCTATCGCTGTGTCTGCCCACCTGGCCATAGTTTAGGCCCCTCCCGTACACAGTGCATTGCAGACAAACCGGAG
GAGAAGAGCCTGTGTTTCCGCCTGGTGAGCCCTGAGCACCAGTGCCAGCACCCACTGACCACCCGCCTGACCCGC
CAGCTCTGCTGCTGCAGTGTCGGCAAGGCCTGGGGCGCGCGGTGTCAGCGCTGCCCAACAGATGGCACCGCTGCG
TTCAAGGAGATCTGCCCAGCTGGGAAGGGATACCACATTCTCACCTCCCACCAGACGCTCACCATTCAGGGCGAG
AGTGACTTTTCCCTTTTCCTGCACCCTGACGGGCCACCCAAGCCCCAGCAGCTTCCGGAGAGCCCTAGCCAGGCT
CCACCACCTGAGGACACAGAGGAAGAGAGAGGGGTGACCACGGACTCACCGGTGAGTGAGGAGAGGTCAGTGCAG
CAGAGCCACCCAACTGCCACCACGACTCCTGCCCGGCCCTACCCCGAGCTGATCTCCCGTCCCTCGCCCCCGACC
ATGCGCTGGTTCCTGCCGGACTTGCCTCCTTCCCGCAGCGCCGTAGAGATCGCTCCCACTCAGGTCACAGAGACT
GATGAGTGCCGACTGAACCAGAACATCTGTGGCCACGGAGAGTGCGTGCCGGGCCCCCTGACTACTCCTGCCAC
TGCAACCCCGGCTACCGGTCACATCCCCAGCACCGCTACTGCGTGGATGTGAACGAGTGCGAGGCAGAGCCCTGT
GGCCCGGGGAGGGGCATCTGCATGAACACCGGCGGCTCCTACAATTGCCACTGCAACCGCGGCTACCGCCTGCAC
GTGGGCGCCGGGGGCGCTCGTGCGTGGACCTGAACGAATGCGCCAAGCCCCACCTGTGCGGCGACGGCGGCTTC
TGCATCAACTTTCCCGGTCACTACAAGTGCAACTGCTACCCCGGCTACCGGCTCAAAGCCTCCCGGCCTCCTGTG
TGCGAAGACATCGACGAGTGCCGGGACCCAAGCTCTTGCCCGGATGGCAAATGCGAGAACAAGCCCGGGAGCTTC
AAGTGCATCGCCTGTCAGCCTGGCTACCGCAGCCAGGGGGCGGGGCCTGTCGCGACGTGAACGAGTGCGCCGAG
GGCAGCCCCTGCTCGCCTGGCTGGTGCGAGAACCTCCCGGGCTCCTTCCGCTGCACCTGTGCCCAGGGCTACGCG
CCCGCGCCCGACGGCCGCAGTTGCTTGGATGTGGACGAGTGTGAGGCTGGGGACGTGTGTGACAATGGCATCTGC
AGCAACACGCCAGGATCTTTCCAGTGTCAGTGCCTCTCTGGCTACCATCTGTCCAGGGACCGGAGCCACTGCGAG
GACATTGATGAGTGTGACTTCCCTGCAGCCTGCATTGGGGGTGACTGCATCAATACCAATGGCTCCTACAGATGT
CTTTGCCCCCAGGGGCATCGGCTGGTGGGTGGCAGGAAATGCCAAGACATAGATGAGTGCAGCCAGGACCCGAGC
CTGTGCCTTCCCCATGGGGCCTGCAAGAACCTTCAGGGCTCCTATGTGTGTGTCTGCGATGAGGGCTTCACTCCC
ACCCAGGACCAGCACGGTTGTGAGGAGGTGGAGCAGCCCCACCACAAGAAGGAGTGCTACCTGAACTTCGATGAC
ACAGTGTTCTGCGACAGCGTATTGGCCACCAACGTGACCCAGCAGGAGTGCTGCTGCTCTCTGGGGCCGGCTGG
GGCGACCACTGCGAAATCTACCCCTGCCCAGTCTACAGCTCAGCCGAGTTCCACAGCCTCTGCCCAGACGGAAAG
GGCTACACCCAGGACAACAACATCGTCAACTACGGCATCCCAGCCCACCGTGACATCGACGAGTGCATGTTGTTC
GGGTCGGAGATTTGCAAGGAGGGCAAGTGCGTGAACACGCAGCCTGGCTACGAGTGCTACTGCAAGCAGGGCTTC
TACTACGACGGGAACCTGCTGGAATGCGTGGACGTGGACGAGTGCCTGGACGAGTCCAACTGCCGGAACGGAGTG
TGTGAGAACACGCGCGGCGGCTACCGCTGTGCCTGCACGCCCCTGCCGAGTACAGTCCCGCGCAGCGCCAGTGC
CTGAGCCCGGAAGAGATGGAGCGTGCCCCGGAGCGGCGCGACGTGTGCTGGAGCCAGCGCGGAGAGGACGGCATG
TGCGCTGGCCCCCTGGCCGGGCCTGCCCTCACCTTCGACGACTGCTGCTGCCGCCAGGCCGCGGCTGGGGCGCC
CAATGCCGACCGTGCCCGCCGCGCGGCGCGGGGTCCCATTGCCCGACATCGCAGAGCGAGAGCAATTCCTTCTGG
GACACAAGCCCCCTGCTGTTGGGGAAGCCCCAAGAGATGAGGACAGTTCAGAGGAGGATTCAGACGAGTGTCGC
TGCGTGAGTGGCCGCTGCGTGCCGCGGCCGGGCGGCGCCGTGTGCGAGTGTCCCGGCGGCTTCCAGCTCGACGCC
```

FIGURE 583B

TCCCGCGCCCGCTGCGTGGATATCGACGAGTGCCGAGAGCTGAACCAGCGCGGGCTGCTGTGCAAGAGCGAGCGC
TGCGTGAACACCAGCGGCTCCTTCCGCTGCGTCTGCAAAGCCGGCTTCGCGCGCAGCCGCCCGCACGGGGCCTGC
GTTCCCCAGCGCCGCCGCTGACGCCGCCGACGCCGCCCTCGGCCCAGACCTCGGTGATCACTGAGGGATTTCCGC
GAGCTCGGCCTCACTTCTGCCCCGACTTGTGGCTCGGACCCAGGGACCTTCAGGGCCCGCAGACCCTCCCGGCGC
CTTGAGACCCGAGGCGCCCCTACCGGCCCCCCTCCCCGGTTAGCGGGCGGTTGTAAGGTCTCCGGCGGGCGCTGC
CTGCCTTCCTCCCAGAGGGTGTTTCCTAGAAACTGATAAATCAGATCGTGCCTCTTTACCCTTGGCTTTCGAAAA
AAAAAAAAAAAAAA

FIGURE 584

MPGPRGAAGGLAPEMRGAGAAGLLALLLLLLLLLGLGGRVEGGPAGERGAGGGGALARERFKVVFAPVICKRTC
LKGQCRDSCQQGSNMTLIGENGHSTDTLTGSGFRVVVCPLPCMNGGQCSSRNQCLCPPDFTGRFCQVPAGGAGGG
TGGSGPGLSRTGALSTGALPPLAPEGDSVASKHAIYAVQVIADPPGPGEGPPAQHAAFLVPLGPGQISAEVQAPP
PVVNVRVHHPPEASVQVHRIESSNAESAAPSQHLLPHPKPSHPRPPTQKPLGRCFQDTLPKQPCGSNPLPGLTKQ
EDCCGSIGTAWGQSKCHKCPQLQYTGVQKPGPVRGEVGADCPQGYKRLNSTHCQDINECAMPGVCRHGDCLNNPG
SYRCVCPPGHSLGPSRTQCIADKPEEKSLCFRLVSPEHQCQHPLTTRLTRQLCCCSVGKAWGARCQRCPTDGTAA
FKEICPAGKGYHILTSHQTLTIQGESDFSLFLHPDGPPKPQQLPESPSQAPPPEDTEEERGVTTDSPVSEERSVQ
QSHPTATTTPARPYPELISRPSPPTMRWFLPDLPPSRSAVEIAPTQVTETDECRLNQNICGHGECVPGPPDYSCH
CNPGYRSHPQHRYCVDVNECEAEPCGPSRGICMNTGGSYNCHCNRGYRLHVGAGGRSCVDLNECAKPHLCGDGGF
CINFPGHYKCNCYPGYRLKASRPPVCEDIDECRDPSSCPDGKCENKPGSFKCIACQPGYRSQGGGACRDVNECAE
GSPCSPGWCENLPGSFRCTCAQGYAPAPDGRSCLDVDECEAGDVCDNGICSNTPGSFQCQCLSGYHLSRDRSHCE
DIDECDFPAACIGGDCINTNGSYRCLCPQGHRLVGGRKCQDIDECSQDPSLCLPHGACKNLQGSYVCVCDEGFTP
TQDQHGCEEVEQPHHKKECYLNFDDTVFCDSVLATNVTQQECCCSLGAGWGDHCEIYPCPVYSSAEFHSLCPDGK
GYTQDNNIVNYGIPAHRDIDECMLFGSEICKEGKCVNTQPGYECYCKQGFYYDGNLLECVDVDECLDESNCRNGV
CENTRGGYRCACTPPAEYSPAQRQCLSPEEMERAPERRDVCWSQRGEDGMCAGPLAGPALTFDDCCCRQGRGWGA
QCRPCPPRGAGSHCPTSQSESNSFWDTSPLLLGKPPRDEDSSEEDSDECRCVSGRCVPRPGGAVCECPGGFQLDA
SRARCVDIDECRELNQRGLLCKSERCVNTSGSFRCVCKAGFARSRPHGACVPQRRR

FIGURE 585

```
CCAAGCTCCAGCTGTTTGTCAAGGCGAGTGAGGACGGGGAGAGCGTGGGTCACTGCCCCTCCTGCCAGCGGTCTT
CATGGTCCTGCTCCTCAAGGGCGTACCTTTCACCCTCACCACGGTGGACACGCGCAGGTCCCCGGACGTGCTGAA
GGACTTCGCCCCCGGCTCGCAGCTGCCCATCCTGCTCTATGACAGCGACGCCAAGACAGACACGCTGCAGATCGA
GGACTTTCTGGAGGAGACGCTGGGGCCGCCCGACTTCCCCAGCCTGGCGCCTCGTTACAGGGAGTCCAACACCGC
CGGCAACGACGTTTTCCACAAGTTCTCCGCGTTCATCAAGAACCCGGTGCCCGCGCAGGACGAAGCCCTGTACCA
GCAGCTGCTGCGCGCCCTCGCCAGGCTGGACAGCTACCTGCGCGCGCCCCTGGAGCACGAGCTGGCGGGGGAGCC
GCAGCTGCGCGAGTCCCGCCGCCGCTTCCTGGACGGCGACAGGCTCACGCTGGCCGACTGCAGCCTCCTGCCCAA
GCTGCACATCGTCGACACGGTGTGCGCGCACTTCCGCCAGGCGCCCATCCCCGCGGAGCTGCGCGGCGTACGCCG
CTACCTGGACAGCGCGATGCAGGAGAAAGAGTTCAAATACACGTGTCCGCACAGCGCCGAGATCCTGGCGGCCTA
CCGGCCCGCCGTGCACCCCCGCTAGCGCCCCACCCCGCGTCTGTCGCCCAATAAAGGCATCTTTGTCGGGAAAAA
AAAAAAAAAAAAAAAAAAAAAAAAAAAAAAAAAAAAAAAAA
```

FIGURE 586

MVLLLKGVPFTLTTVDTRRSPDVLKDFAPGSQLPILLYDSDAKTDTLQIEDFLEETLGPPDFPSLAPRYRESNTA
GNDVFHKFSAFIKNPVPAQDEALYQQLLRALARLDSYLRAPLEHELAGEPQLRESRRRFLDGDRLTLADCSLLPK
LHIVDTVCAHFRQAPIPAELRGVRRYLDSAMQEKEFKYTCPHSAEILAAYRPAVHPR

FIGURE 587A

```
CGCCCGGGCAGGTGGCGGCAGAGCTGAAGTGAGCGGAGCCACCAGGAGGCCATGTCGGGTGAGGACGCTGAGGTC
CGGGCAGTCTCTGAAGATGTCTCCAATGGAAGCAGTGGCTCGCCCAGCCCTGGGGACACACTGCCCTGGAACCTT
GGGAAAACGCAGCGGAGCCGGCGCAGCGGGGGTGGCGCTGGGAGCAACGGGAGTGTCCTGGACCCAGCTGAGCGG
GCGGTCATTCGCATCGCAGATGAGCGGGATCGTGTGCAGAAGAAAACCTTCACCAAGTGGGTCAACAAGCACCTC
ATCAAGGCCCAGAGGCACATCAGTGACCTGTATGAAGACCTCCGCGATGGCCACAACCTCATCTCCCTGCTGGAG
GTCCTCTCGGGGGACAGCCTGCCCCGGGAGAAGGGGAGGATGCGTTTCCACAAGCTGCAGAATGTCCAGATTGCC
CTGGACTACCTCCGGCACCGCCAGGTGAAGCTGGTGAACATCAGGGATGATGACATCGCTGACGGCAACCCCAAG
CTGACCCTTGGCCTCATCTGGACAATCATTCTGCACTTCCAGATCTCAGATATCCAGGTGAGTGGGCAGTCGGAG
GACATGACGGCCAAGGAGAAGCTGCTGCTGTGGTCGCAGCGAATGGTGGAGGGGTACCAGGGCCTGCGATGCGAC
AACTTCACCTCCAGCTGGAGAGACGGCCGCCTCTTCAATGCCATCATCCACCGGCACAAGCCCCTGCTCATCGAC
ATGAACAAGGTGTACCGGCAGACCAACCTGGAGAACCTGGACCAGGCCTTCTCTGTGGCGGAGCGGGACCTGGGA
GTGACGCGGCTCCTGGACCCTGAGGACGTGGATGTCCCTCAGCCCGACGAGAAGTCCATCATCACCTACGTCTCG
TCGCTGTATGACGCCATGCCCCGCGTGCCGGACGTGCAGGATGGGGTGAGGGCCAACGAGCTGCAGCTGCGCTGG
CAGGAGTACCGGGAGCTGGTGCTGCTGCTGCTTCAGTGGATGCGACACCACACGGCCGCCTTTGAGGAACGCAGG
TTCCCCTCCAGCTTCGAGGAGATTGAGATCCTGTGGTCTCAGTTCCTGAAGTTTAAGGAGATGGAGCTACCAGCC
AAGGAGGCCGACAAGAACAGGTCCAAGGGCATCTACCAATCCCTGGAGGGAGCGGTGCAAGCAGGCCAGCTCAAG
GTGCCCCCTGGCTACCACCCGCTGGATGTGGAGAAGGAGTGGGGCAAGCTGCACGTGGCCATCCTGGAGCGGGAG
AAGCAGCTCCGCAGCGAGTTTGAGAGGCTGGAGTGTCTTCAGCGCATCGTGACCAAGCTGCAGATGGAGGCGGGG
CTGTGTGAGGAGCAGCTGAACCAGGCCGACGCCCTGCTGCAGTCGGATGTCCGGCTGCTGGCTGCAGGCAAAGTG
CCACAGCGGGCGGGGAGGTGGAACGGGACTTGGACAAGGCGGATAGCATGATCCGGCTGCTCTTCAACGACGTG
CAGACCCTCAAGGATGGACGGCACCCGCAGGGCGAGCAGATGTACCGCAGGGTGTACCGTCTGCACGAGCGCCTG
GTAGCCATCCGCACCGAGTACAACCTACGGCTGAAGGCAGGCGTGGCGGCCCCTGCAACCCAGGTGGCCCAGGTG
ACTCTGCAGAGTGTGCAGAGGCGCCCCGAGCTGGAGGACTCCACTCTGCGCTACCTGCAGGACCTGCTGGCCTGG
GTGGAGGAGAACCAGCACCGTGTGGATGGCGCTGAGTGGGGTGTGGACCTGCCCAGCGTGGAGGCGCAGCTGGGC
AGCCACCGAGGCCTGCACCAGTCCATCGAAGAATTCCGGGCCAAGATCGAGCGGGCACGGAGTGACGAGGGCCAG
CTCTCCCCCGCCACCCGGGGTGCCTACCGTGACTGCCTGGGTCGGCTGGACCTGCAGTACGCCAAGCTGCTGAAC
TCCTCCAAGGCCCGCCTCAGGTCCCTGGAGAGCTTGCACAGCTTTGTGGCAGCCGCCACTAAGGAGCTAATGTGG
CTGAATGAGAAGGAGGAGGAGGAGGTGGGCTTCGACTGGAGCGACCGCAACACCAACATGACCGCCAAGAAGGAG
AGCTACTCGGCGCTGATGCGGGAGCTGGAGCTGAAGGAGAAGAAGATCAAGGAGCTCCAAAATGCTGGGGACCGG
CTGCTGCGGGAGGACCACCCGGCCCGGCCCACGGTGGAGTCCTTCCAGGCGGCCCTGCAGACGCAGTGGAGCTGG
ATGCTACAGCTGTGCTGCTGTATCGAGGCACACCTGAAGGAGAACGCTGCCTACTTTCAGTTCTTCTCAGATGTG
CGGGAGGCCGAGGGGCAGTTGCAGAAGCTGCAGGAGGCACTGCGTAGGAAATACAGTTGTGATCGCTCCGCCACC
GTCACCCGGCTGGAGGACCTGCTGCAGGATGCCCAGGACGAGAAGGAACAGCTGAACGAGTACAAGGGCCACCTC
TCAGGCCTGGCCAAGCGGGCCAAGGCCGTCGTGCAGCTGAAGCCCCGCCACCCAGCCCACCCCATGCGGGGCCGC
CTGCCCCTGCTGGCCGTGTGCGACTATAAGCAGGTGGAGGTGACTGTGCACAAGGGTGACGAGTGCCAGCTGGTG
GGCCCTGCACAGCCGTCCCACTGGAAGGTGCTCAGCAGCTCCGGCAGCGAGGCCGCCGTGCCCTCCGTGTGCTTC
CTGGTGCCCCCGCCCAACCAGGAGGCCCAGGAGGCCGTCACCAGGCTGGAGGCCCAGCACCAGGCCCTGGTCACG
CTGTGGCACCAGTTGCACGTGGACATGAAGAGCCTTCTGGCCTGGCAGAGCCTTCGCCGCGACGTGCAGCTCATC
CGCTCGTGGTCCCTGGCCACGTTCCGCACCCTGAAGCCAGAGGAGCAGCGCCAAGCCCTGCACAGCCTGGAGCTG
CACTACCAGGCCTTCCTGCGGGACAGCCAGGACGCGGGCGGCTTCGGACCCGAGGACCGGCTGATGGCTGAGCGC
GAGTACGGCTCCTGCAGCCACCACTACCAGCAGCTGCTGCAGAGCCTGGAACAGGGTGCACAGGAAGAGTCTCGC
TGCCAGCGCTGCATCTCCGAGCTCAAAGACATCCGGCTGCAGCTGGAGGCCTGTGAGACGCGCACCGTGCACCGC
CTGCGGCTGCCGCTGGACAAAGAGCCGGCACGGGAGTGTGCCCAGCGCATCGCCGAGCAGCAGAAGGCACAGGCA
GAGGTGGAGGGGCTGGGCAAGGGGGTCGCCCGGCTCTCTGCCGAGGCCGAGAAGGTCTTGGCCCTACCAGAGCCA
TCGCCTGCGGCCCCCACGCTGCGCTCGGAGCTGGAGCTGACGCTGGGCAAGCTGGAGCAGGTCCGCAGCCTGTCT
GCCATCTACCTGGAGAAGCTCAAGACCATCAGCCTGGTGATCCGCGGCACGCAGGGGGCCGAGGAGGTGCTCAGG
GCCCACGAGGAGCAGCTCAAGGAGGCCCAGGCCGTGCCGGCCACCCTCCCGGAGCTCGAGGCCACCAAGGCCTCT
CTGAAGAAGCTGCGGGCCCAGGCCGAGGCACAGCAGCCCACGTTCGACGCCCTGCGGGATGAGCTGCGGGGGGCA
```

FIGURE 587B

```
CAGGAGGTGGGGGAGCGACTGCAGCAGCGGCACGGGGAGCGGGACTTGGAGGTGGAGCGCTGGCGGGAGCGGGTC
GCCCAGGTGCTTGAGCGCTGGCAGGCTGTGCTGGCCCAGACCGACTTGCGGCAGCGCGAGCTCGAGCAACTGGGC
CGCCAGCTGCGTTACTACCGCGAGAGTGCAGACCCCTTGGGCGCCTGGCTGCAGGACGCCAGGCGGCGGCAGGAG
CAGATCCAGGCCATGCCGCTGGCCGACAGCCAGGCTGTGCGGGAGCAGCTGCGGCAGGAGCAGGCCCTGCTGGAG
GAGATCGAGCGCCACGGCGAGAAGGTCGAGGAGTGCCAGAGGTTTGCGAAACAGTACATCAACGCCATCAAGGAC
TATGAACTCCAGCTGGTGACGTACAAGGCGCAGCTTGAGCCGGTGGCCTCCCCGGCCAAGAAGCCCAAGGTCCAG
TCGGGATCAGAGAGTGTCATCCAGGAGTACGTGGACCTGCGTACGCACTACAGCGAGCTGACCACACTGACGAGC
CAGTACATCAAGTTCATCAGCGAGACTCTGCGGCGCATGGAGGAGGAGGAGAGGCTGGCTGAGCAGCAGCGGGCA
GAGGAGCGCGAGCGGCTGGCCGAGGTGGAGGCCGCGCTGGAGAAGCAGCGGCAGCTGGCCGAGGCGCACGCCCAG
GCAAAGGCACAGGCGGAGCGGGAGGCGAAGGAGCTGCAGCAGCGCATGCAGGAGGAGGTGGTGCGGCGGGAGGAG
GCGGCGGTGGACGCGCAGCAGCAGAAGCGCAGCATTCAGGAGGAGCTGCAGCAGCTGCGGCAGAGCTCGGAGGCG
GAGATCCAGGCCAAGGCCCGGCAGGCAGAGGCGGCTGAGCGCAGCCGGCTGCGCATCGAGGAGGAGATCCGCGTG
GTGCGCCTGCAGTTGGAGGCCACCGAGCGCCAGCGTGGCGGGGCTGAGGGGGAGCTGCAGGCACTGCGTGCACGG
GCGGAGGAGGCTGAGGCACAAAAAGCGACAGGCGCAGGAGGAGGCCGAGCGCTTGCGGAGGCAGGTGCAGGACGAG
AGCCAGCGTAAGCGGCAGGCGGAGGTGGAGCTGGCCTCGCGCGTGAAGGCCGAGACCGAGGCGGCGCGCGAGAAG
CAGCGGGCCCTGCAGGCCCTGGAGGAGCTGCGGCTGCAGGCGGAGGAGGCGGAGCGGCGCCTGCGGCAGGCCGAG
GTGGAGCGAGCGCGGCAGGTACAGGTGGCCCTGGAGACGGCGCAGCGCAGTGCAGAGGCGGAGCTGCAGAGCAAA
CGCGCCTCCTTCGCCGAGAAGACGGCACAGCTGGAGCGCTCCCTGCAGGAGGAACACGTGGCTGTGGCACAGCTG
CGGGAGGAGGCTGAGCGGCGGGCACAGCAGCAGGCCGAGGCCGAGCGGGCGCGCGAGGAGGCAGAGCGGGAGCTG
GAGCGCTGGCAGCTCAAGGCCAACGAGGCGCTACGGCTGCGGCTGCAGGCGGAGGAGGTGGCGCAGCAGAAGAGC
CTGGCGCAGGCCGAGGCTGAGAAGCAGAAGGAGGAGGCGGAGCGCGAGGCGCGGCGGCGCGGCAAGGCGGAGGAG
CAGGCCGTCCGGCAGCGGGAGCTGGCTGAACAAGAGCTGGAGAAGCAGCGGCAGCTGGCGGAAGGCACCGCGCAG
CAGCGCCTGGCCGCGGAGCAGGAGTTGATCCGGCTGCGGGCCGAGACGGAGCAGGGGGAGCAGCAGCGGCAGCTG
CTGGAGGAGGAGCTGGCCCGGCTGCAGCGTGAGGCGGCTGCAGCCACGCAGAAACGGCAGGAGCTGGAAGCCGAG
CTGGCCAAGGTGCGGGCCGAGATGGAGGTGCTGCTGGCCAGCAAGGCGAGGGCTGAGGAGGAGTCGCGCTCCACC
AGCGAGAAGTCCAAGCAGAGGCTGGAGGCCGAGGCCGGCCGGTTCCGCGAGCTGGCCGAGGAGGCCGCCCGCCTG
CGTGCCCTGGCGGAAGAGGCCAAGCGGCAGCGGCAGCTGGCCGAGGAAGACGCGGCGCGGCAGCGGGCCGAGGCG
GAGCGGGTGCTTGCGGAGAAGCTGGCCGCCATCGGCGAGGCCACGCGGCTCAAGACGGAGGCGGAGATCGCGCTC
AAGGAGAAGGAGGCGGAGAACGAGCGCCTGCGGCGGCTGGCGGAGGACGAGGCCTTCCAGCGGCGGCGGCTGGAG
GAGCAGGCCGCGCAACACAAGGCTGACATCGAGGAGCGCCTGGCCCAGCTGCGCAAGGCATCGGACAGCGAGCTG
GAGCGGCAGAAGGGGCTGGTGGAGGACACGCTGAGGCAGCGGCGGCAGGTGGAGGAAGAGATCCTGGCGCTGAAG
GCGAGCTTCGAGAAGGCGGCCGCTGGCAAGGCGGAGCTGGAGCTGGAGCTGGGACGCATCCGGAGCAACGCGGAG
GACACGCTGCGCAGCAAGGAGCAGGCCGAGCTGGAGGCCGCGAGGCAGCGGCAGCTGGCGGCGGAGGAGGAGCGG
CGGCGCCGTGAGGCTGAGGAGCGCGTGCAGAAGAGCCTGGCGGCCGAGGAGGAGGCCGCACGGCAGCGGAAGGCG
GCGCTGGAGGAAGTCGAGCGGCTGAAAGCCAACGTGGAGGAGGCGCGGCGCCTGCGGGAGCGAGCGGAGCAGGAG
TCGGCGCGGCAGCTGCAGCTGGCCCAGGAGGCCGCCCAGAAGCGGCTGCAGGCGGAAGAGAAGGCACACGCCTTC
GCGGTGCAGCAGAAGGAGCAGGAGCTACAGCAGACGCTGCAGCAGGAGCAGAGCGTGCTGGACCAGCTGCGCGGC
GAGGCGGAGGCGGCCCGGCGGGCGGCTGAGGAGGCGGAGGAGCCCGGGTGCAGGCGGAGCGTGAGGCGGCGCAG
GCCCGGCGGCAGGTGGAAGAGGCCGAGCGGCTGAAGCAGTCGGCAGAGGAGCAGGCACAGGCCCGGGCTCAGGCA
CAGGCGGCTGCAGAGAAGCTGCGCAAGGAGGCCGAGCAAGAGGCGGCGCGGCGGGCACAGGCGGAGCAGGCGGCC
CTGCGGCAGAAGCAGGCAGCTGACGCGGAGATGGAGAAGCATAAGAAATTCGCCGAGCAGACGCTGCGGCAGAAG
GCGCAGGTGGAGCAGGAGCTGACAACACTGCGGCTGCAGCTGGAGGAGACCGACCACCAGAAGAACCTGCTGGAC
GAGGAGCTGCAGCGGCTGAAGGCGGAGGCCACGGAGGCCGCACGCCAGCGCAGCCAGGTGGAGGAGGAGCTCTTC
TCGGTGCGCGTGCAGATGGAGGAGCTGAGCAAGCTCAAGGCACGCATCGAGGCTGAGAACCGCGCACTCATCTTG
CGTGACAAGGACAATACGCAGCGCTTCCTGCAGGAGGAGGCTGAGAAGATGAAGCAGGTGGCGGAGGAGGCCGCG
CGGCTGAGTGTGGCGGCCCAAGAGGCTGCGCGACTGCGGCAGCTGGCAGAGGAGGACCTGGCACAGCAGCGGGCC
TTGGCAGAGAAGATGCTCAAGGAGAAGATGCAGGCGGTGCAGGAGGCCACGCGACTCAAGGCTGAGGCGGAACTG
CTGCAGCAGCAGAAGGAGCTTGCGCAGGAGCAGGCGCGGCGGCTGCAGGAGGACAAGGAGCAGATGGCGCAGCAG
```

FIGURE 587C

```
CTGGCGGAGGAGACGCAGGGCTTCCAGCGGACGCTGGAGGCCGAGCGGCAGCGGCAGCTGGAGATGAGCGCTGAG
GCTGAGCGCCTCAAGCTGCGTGTGGCCGAGATGAGCCGAGCCCAGGCCCGCGCTGAGGAGGACGCCCAGCGCTTC
CGGAAGCAGGCGGAGGAGATCGGTGAGAAGCTGCACCGCACGGAGCTCGCCACCCAGGAGAAGGTGACCCTGGTG
CAGACACTGGAGATCCAGCGACAGCAGAGTGACCATGATGCCGAGCGCCTGCGGGAGGCCATCGCTGAGCTGGAG
CGTGAGAAGGAGAAGCTCCAACAGGAGGCCAAACTGCTGCAGCTCAAGTCTGAGGAGATGCAGACGGTGCAGCAG
GAGCAGCTGCTGCAGGAGACGCAGGCCCTGCAGCAAAGCTTCCTCTCTGAAAAGGACAGCCTGCTACAGCGGGAG
CGCTTCATCGAGCAGGAGAAGGCCAAGCTGGAGCAGCTCTTCCAGGACGAGGTGGCCAAGGCACAGCAGCTGCGT
GAGGAGCAGCAGCGGCAGCAGCAGCAGATGGAGCAGGAACGGCAGCGGCTGGTGGCCAGCATGGAGGAGGCGCGG
CGGCGGCAGCATGAGGCCGAGGAGGGCGTGCGGCGCAAGCAGGAGGAGCTGCAGCAGCTGGAGCAGCAGCGGCGG
CAGCAGGAGGAGCTGCTGGCTGAGGAGAACCAGAGGCTGCGTGAGCAGCTGCAGCTCCTGGAGGAGCAGCACCGG
GCCGCGCTGGCGCACTCAGAGGAGGTCACTGCCTCGCAGGTGGCTGCCACAAAGACCCTGCCCAATGGCCGGGAT
GCACTTGATGGCCCCGCGGCAGAGGCAGAGCCGGAGCACAGCTTCGATGGCCTGCGGCGGAAGGTGTCAGCTCAG
AGGCTGCAGGAGGCCGGCATCCTGAGTGCGGAGGAGCTGCAGCGGTTGGCGCAGGGCCACACCACGGTGGACGAG
CTCGCACGGCGGGAAGACGTGCGCCACTACCTGCAGGGCCGCAGCAGTATCGCAGGGCTGTTGCTGAAGGCCACC
AATGAGAAGCTGAGTGTTTACGCCGCCCTGCAGAGGCAGCTGCTGAGTCCCGGCACGGCCCTCATCCTGCTGGAG
GCGCAGGCGGCCTCAGGCTTCCTGCTGGACCCTGTGCGGAACCGGCGGCTGACCGTCAACGAGGCTGTGAAGGAG
GGTGTGGTGGGCCCCGAGCTGCACCACAAGCTGCTGTCGGCCGAGCGCGCCGTCACTGGCTACAAGGACCCCTAC
ACTGGCCAGCAGATCTCTCTCTTCCAAGCCATGCAGAAGGGCCTCATCGTCCGGGAGCACGGCATCCGCCTGCTG
GAGGCCCAGATCGCCACGGGCGGCGTTATCGACCCCGTGCACAGCCACCGCGTGCCCGTGGACGTGGCCTACCGG
CGCGGCTACTTCGACGAGGAGATGAACCGCGTCCTGGCGGACCCCAGCGACGACACCAAGGGCTTCTTTGACCCC
AACACGCACGAGAACCTCACGTACCTGCAGCTACTGGAGCGCTGCGTGGAGGACCCCGAGACGGGCCTGTGCCTT
CTGCCACTCACGGATAAGGCTGCCGAGGGCGGGGAGCTGGTCTACACTGACTCCGAGGCCCGGGACGTCTTTGAG
AAGGCCACCGTGTCTGCGCCGTTCGGCAAGTTCCAGGGCAAGACGGTGACCATTTGGGAGATCATCAACTCGGAA
TACTTCACGGCAGAGCAGCGGCGGGACCTGCTGCGGCAGTTCCGCACGGGCCGGATCACAGTGGAGAAGATCATC
AAGATCATCATCACGGTGGTGGAGGAGCAGGAGCAGAAGGGCCGGCTTTGCTTTGAGGGCCTGCGCAGCCTGGTG
CCAGCCGCCGAGCTGCTGGAGAGCAGGGTCATCGACCGCGAGCTCTACCAGCAGCTGCAGCGAGGTGAGCGCTCT
GTGCGAGACGTAGCCGAGGTGGACACTGTGCGGCGGGCTCTCCGGGGTGCCAACGTCATCGCGGGTGTATGGCTG
GAGGAGGCGGGGCAGAAGCTGAGTATCTACAATGCCCTGAAGAAAGACCTGCTGCCATCCGACATGGCCGTGGCC
CTGTTGGAAGCCCAGGCCGGCACCGGGCACATCATCGACCCCGCCACCAGCGCCCGGCTGACCGTGGACGAGGCA
GTGCGTGCTGGCCTGGTGGGCCCCGAGTTTCATGAGAAGCTGCTATCAGCCGAGAAGGCTGTGACAGGGTACAGG
GACCCCTACACAGGGCAGAGCGTCTCCCTGTTCCAGGCCCTGAAGAAGGGCCTCATTCCCCGGGAGCAGGGCCTG
CGCCTGTTGGACGCCCAGCTGTCCACGGGCGGCATCGTGGACCCCAGCAAGAGCCACCGCGTGCCCCTGGATGTC
GCCTGCGCCCGAGGCTGCCTGGATGAGGAGACCAGCAGGGCCCTGTCGGCACCAAGGGCCGACGCCAAGGCCTAC
AGTGACCCCAGCACAGGGGAGCCGGCCACCTACGGCGAGCTCCAGCAGCGGTGCCGGCCCGACCAGCTGACCGGG
CTGAGCCTGCTGCCGCTCTCAGAAAAGGCTGCTCGGGCCCGGCAGGAGGAGCTCTACTCAGAGCTGCAGGCCCGT
GAGACCTTTGAAAAGACCCCGGTTGAGGTCCCCGTGGGTGGCTTCAAGGGCAGGACGGTGACGGTGTGGGAGCTC
ATCAGCTCTGAGTACTTCACTGCGGAGCAGCGGCAGGAGCTGTTGCGTCAGTTCCGCACGGGCAAGGTCACCGTG
GAGAAGGTCATCAAGATTCTCATTACCATCGTGGAGGAGGTGGAGACCCTGCGGCAGGAGAGGCTGTCCTTCAGC
GGCCTCCGTGCCCCTGTGCCAGCCAGCGAGCTCCTGGCTTCCGGGGTGCTCAGCAGAGCCCAGTTTGAGCAGCTC
AAGGACGGCAAGACGACGGTCAAGGACCTTTCGGAGCTGGGCTCCGTGCGGACGCTGCTGCAGGGCAGTGGCTGC
CTCGCCGGCATCTACCTGGAGGACACCAAGGAGAAGGTGTCCATCTACGAGGCCATGCGCCGGGGCCTGCTGAGA
GCCACAACGGCTGCGCTCCTGCTGGAGGCGCAGGCGGCCACTGGCTTCCTGGTGGACCCCGTGCGGAACCAGCGC
CTGTATGTCCACGAGGCCGTGAAGGCGGGCGTGGTGGGCCCCGAGCTTCACGAGCAGCTGCTGTCTGCCGAGAAG
GCCGTCACCGGCTACAGAGACCCCTACTCGGGCAGCACCATCTCCCTCTTCCAGGCCATGCAGAAGGGCCTGGTT
CTCCGGCAGCACGGCATCCGCCTGCTGGAGGCCCAGATCGCCACGGGCGGCATCATCGACCCCGTGCACAGCCAC
CGCGTGCCTGTGGACGTGGCCTACCAGCGCGGCTACTTCAGTGAGGAGATGAACCGCGTCCTGGCGGACCCCAGC
GACGACACCAAGGGCTTCTTTGACCCCAACACGCATGAGAACCTCACGTACAGGCAGCTGCTGGAGCGGTGCGTG
GAGGACCCCGAGACGGGCTTGCGCCTTCTGCCACTGAAAGGGGCGGAGAAGGCTGAGGTGGTGGAGACCACGCAG
```

FIGURE 587D

```
GTGTACACTGAGGAGGAGACAAGAAGGGCATTTGAAGAGACACAGATCGACATTCCCGGCGGCGGCAGCCACGGC
GGCTCCACCATGTCCCTGTGGGAGGTGATGCAGTCGGACCTGATCCCCGAGGAGCAGCGGGCCCAGCTGATGGCT
GACTTCCAGGCCGGCCGGGTGACCAAGGAACGCATGATCATCATCATCATCGAGATCATTGAGAAGACAGAGATC
ATCCGCCAGCAGGGTCTGGCCTCCTATGACTACGTGCGCCGCCGCCTCACGGCTGAGGACCTGTTCGAGGCTCGG
ATCATCTCTCTCGAGACCTACAACCTGCTCCGGGAGGGCACCAGGAGCCTCCGTGAGGCTCTCGAGGCGGAGTCC
GCCTGGTGCTACCTCTATGGCACGGGCTCCGTGGCTGGTGTCTACCTGCCCGGTTCCAGGCAGACACTGAGCATC
TACCAGGCTCTCAAGAAAGGGCTGCTGAGTGCCGAGGTGGCCCGCCTGCTGCTGGAGGCACAGGCAGCCACAGGC
TTCCTGCTGGACCCGGTGAAGGGGGAGCGGCTGACTGTGGATGAGGCTGTGCGGAAGGGCCTCGTGGGGCCCGAG
CTGCACGACCGCCTGCTCTCGGCTGAGCGGGCGGTCACCGGCTACCGTGACCCCTACACCGAGCAGACCATCTCG
CTCTTCCAGGCCATGAAGAAGGAGCTGATCCCTACTGAGGAGGCCCTGCGGCTGCTGGATGCCCAGCTGGCCACC
GGCGGCATCGTGGACCCCCGCCTGGGCTTCCACCTTCCCTGGAGGTGGCTTACCAGCGTGGCTACCTCAACAAG
GACACGCACGACCAGCTGTCAGAGCCCAGCGAGGTGCGCAGCTACGTGGACCCGTCCACCGACGAGCGCCTCAGC
TACACGCAGCTGCTCAGGCGGTGCCGTCGTGACGACGGCACCGGCCAGCTGCTCCTGCCACTGTCGGACGCCCGC
AAGCTGACCTTCCGTGGCCTGCGGAAGCAGATCACCATGGAGGAGCTGGTGCGCTCGCAGGTCATGGACGAGGCC
ACGGCGCTGCAGCTGCGGGAGGGCCTGACCTCCATCGAGGAGGTCACCAAGAACTTGCAGAAGTTCCTGGAAGGC
ACCAGCTGCATCGCTGGTGTCTTCGTGGACGCCACCAAGGAACGGCTCTCGGTGTACCAGGCCATGAAGAAAGGC
ATCATCCGCCCCGGCACAGCCTTTGAGCTCCTGGAGGCGCAGGCGGCCACCGGTTACGTCATCGACCCCATCAAG
GGACTGAAGCTGACGGTGGAGGAGGCTGTGCGTATGGGCATTGTGGGCCCCGAGTTCAAGGACAAGCTGCTGTCG
GCCGAGCGCGCCGTCACTGGGTACAAGGACCCCTACTCTGGGAAGCTCATCTCCCTCTTCCAGGCCATGAAGAAG
GGCCTGATCCTGAAGGACCATGGCATCCGCCTGCTGGAGGCCCAGATCGCCACGGGCGGCATCATCGACCCTGAG
GAGAGCCACCGGCTGCCCGTGGAGGTGGCCTACAAGCGCGGCCTCTTCGATGAGGAGATGAACGAGATCCTGACC
GACCCCTCGGACGACACCAAGGGCTTCTTTGACCCTAACACGGAGGAGAACCTCACCTACCTGCAGCTGATGGAG
CGTTGTATCACTGACCCCCAGACGGGCCTGTGTCTCTTGCCGCTGAAGGAGAAGAAGCGGGAGCGGAAGACGTCC
TCCAAGTCCTCCGTGCGCAAGCGCCGAGTGGTCATCGTGGACCCCGAGACGGGCAAGGAGATGTCAGTGTACGAG
GCCTACCGCAAGGGCCTGATTGACCACCAGACGTACCTGGAGCTGTCCGAGCAGGAGTGCGAGTGGGAGGAGATC
ACCATCTCCTCCTCGGACGGCGTGGTCAAGTCCATGATCATCGACCGCCGCTCCGGGCGCCAGTACGACATCGAT
GATGCCATCGCCAAGAACCTCATCGACCGCTCGGCACTGGACCAGTACCGCGCCGGCACGCTCTCCATCACCGAG
TTCGCCGACATGCTCTCGGGCAACGCCGGTGGTTTCCGCTCCCGTTCCTCCTCGGTGGGATCCTCCTCCTCCTAC
CCCATCAGCCCCGCCGTCTCCAGGACCCAGCTGGCCTCCTGGTCAGACCCCACTGAGGAGACGGGCCCCGTGGCT
GGCATCCTGGACACGGAGACGCTGGAGAAGGTGTCCATCACCGAGGCCATGCACCGGAACCTGGTGGATAACATC
ACGGGGCAGCGGCTGCTGGAGGCGCAGGCCTGCACCGGGGCATCATCGACCCCAGCACCGGTGAGCGCTTCCCT
GTCACCGACGCCGTCAACAAGGGCCTGGTGGACAAGATCATGGTGGACCGCATCAACCTGGCCCAGAAGGCCTTT
TGCGGCTTCGAGGACCCACGCACCAAGACCAAGATGTCGGCCGCCCAGGCCCTGAAGAAGGGCTGGCTCTACTAC
GAGGCCGGCCAGCGCTTCCTGGAGGTGCAGTACCTGACCGGCGGCTTGATCGAGCCCGACACGCCGGGCCGCGTG
CCCCTGGACGAGGCCCTGCAGCGCGGCACGGTGGACGCCCGCACCGCACAGAAGCTGCGTGACGTGGGCGCCTAC
TCCAAGTACCTCACCTGCCCTAAGACCAAGCTCAAGATCTCCTATAAGGACGCGCTGGACCGCAGCATGGTGGAG
GAGGGCACGGGGCTGCGGCTGCTGGAGGCTGCCGCGCAGTCCACCAAGGGCTACTACAGCCCCTACAGCGTCAGC
GGCTCCGGCTCTACCGCTGGCTCCCGCACCGGCTCGCGCACCGGCTCCCGGGCCGGCTCCCGCCGCGGCAGCTTT
GACGCCACCGGCTCCGGCTTCTCCATGACCTTCTCTTCATCCTCCTACTCCTCCTCGGGCTACGGCCGCCGCTAC
GCCTCGGGTCCTCGGCCTCCCTGGGGGCCCTGAGTCTGCCGTGGCCTGAGGCTGCCTGCGCCCACCCCGCTCT
GCATGCGGCCCAGCCCGGCTCCCACCGAGGCGCGGGGGCCGTTTTCAACGCTTAAAGGTGTCTTCCTCCCAAGTG
GTGCCTAAAGTTTAACCAAAAAGACCAGACTAATATATTAATATATATCTGCTGTCCAGACAGCCTGTATCTTGG
GGGACAGGGCTGGCCCAGCCCTGCTGGCCGCCTCACCCCCTCGGGTCTCCTCACTCCCTTCTACCTGCCACTCAC
ACAGCCAGGTGCCTTGGAGGGTCCCAAGCTGGGCCCCAGCCCACCCTCCTGTCTTCCCAGGGTAGCCCGCCTGCC
AGTCCTAGCTGCACAGGGCAGCTGGGCCCAACCCTGTCTGTAGAGGGCCCTGGTGTTTCTAGCACTGGCCTGCAC
GGTGGGCCTTGCTGGGGACGGGGGGCCCCAGTCAGCCTCTCTCCCAGTCTACCCAGAGAAGCCCCTTCCCCATGG
GAAGACGAGGCCCTCGGGCCCAGCCCCCACAGTGCTGTCTGATCTGTGCTTTCCAGCTCACCCCCCACACTCACT
CCTGAGACCCCTGGCCTCCGGCGTCAGCCTCCAGCCTCTGTTCCCCTAGTAAGTGCCTTCCATGTCGGCCTCTAA
```

FIGURE 587E

```
CCCCAGGCCCCGAGGACCCAGACCCAGTGGGGAGGCGGACGTTCCAGCCGGCATGGCTGGGAACTGCAGACCTGT
CCTCCTGGTGGGTCCAGGGGCCCCTCCAGCTTGTGGAGCCCCACACTGGGGTGCCGCCTGCCCGTCTCTCTCCCA
TGGAGCCCCAGCCCCCTTTGGGCCCAGGGACACCAGCCAGGCTCTGTGCTGACCCTCCTGTTGCGCCCAGCCCTG
GTCTCAGCAGCGACCACCCCTGCCTCCACCCTCTGAGCTTTGCATGTTCCACTAACCCCGGGCGGGTGGCAGGTG
GAGGTGTCAGGCTGCTGGCGCCTCTGCAAGGGCAGAACACTAACCTGACCGTGGGCGGGGCCTTGCGGTATCCGC
CCCCAATAAAAGCAATTCCAACCTT
```

FIGURE 588

MSGEDAEVRAVSEDVSNGSSGSPSPGDTLPWNLGKTQRSRRSGGGAGSNGSVLDPAERAVIRIADERDRVQKKTF
TKWVNKHLIKAQRHISDLYEDLRDGHNLISLLEVLSGDSLPREKGRMRFHKLQNVQIALDYLRHRQVKLVNIRDD
DIADGNPKLTLGLIWTIILHFQISDIQVSGQSEDMTAKEKLLLWSQRMVEGYQGLRCDNFTSSWRDGRLFNAIIH
RHKPLLIDMNKVYRQTNLENLDQAFSVAERDLGVTRLLDPEDVDVPQPDEKSIITYVSSLYDAMPRVPDVQDGVR
ANELQLRWQEYRELVLLLQWMRHHTAAFEERRFPSSFEEIEILWSQFLKFKEMELPAKEADKNRSKGIYQSLEG
AVQAGQLKVPPGYHPLDVEKEWGKLHVAILEREKQLRSEFERLECLQRIVTKLQMEAGLCEEQLNQADALLQSDV
RLLAAGKVPQRAGEVERDLDKADSMIRLLFNDVQTLKDGRHPQGEQMYRRVYRLHERLVAIRTEYNLRLKAGVAA
PATQVAQVTLQSVQRRPELEDSTLRYLQDLLAWVEENQHRVDGAEWGVDLPSVEAQLGSHRGLHQSIEEFRAKIE
RARSDEGQLSPATRGAYRDCLGRLDLQYAKLLNSSKARLRSLESLHSFVAAATKELMWLNEKEEEEVGFDWSDRN
TNMTAKKESYSALMRELELKEKKIKELQNAGDRLLREDHPARPTVESFQAALQTQWSWMLQLCCCIEAHLKENAA
YFQFFSDVREAEGQLQKLQEALRRKYSCDRSATVTRLEDLLQDAQDEKEQLNEYKGHLSGLAKRAKAVVQLKPRH
PAHPMRGRLPLLAVCDYKQVEVTVHKGDECQLVGPAQPSHWKVLSSSGSEAAVPSVCFLVPPPNQEAQEAVTRLE
AQHQALVTLWHQLHVDMKSLLAWQSLRRDVQLIRSWSLATFRTLKPEEQRQALHSLELHYQAFLRDSQDAGGFGP
EDRLMAEREYGSCSHHYQQLLQSLEQGAQEESRCQRCISELKDIRLQLEACETRTVHRLRLPLDKEPARECAQRI
AEQQKAQAEVEGLGKGVARLSAEAEKVLALPEPSPAAPTLRSELELTLGKLEQVRSLSAIYLEKLKTISLVIRGT
QGAEEVLRAHEEQLKEAQAVPATLPELEATKASLKKLRAQAEAQQPTFDALRDELRGAQEVGERLQQRHGERDLE
VERWRERVAQVLERWQAVLAQTDLRQRELEQLGRQLRYYRESADPLGAWLQDARRRQEQIQAMPLADSQAVREQL
RQEQALLEEIERHGEKVEECQRFAKQYINAIKDYELQLVTYKAQLEPVASPAKKPKVQSGSESVIQEYVDLRTHY
SELTTLTSQYIKFISETLRRMEEEERLAEQQRAEERERLAEVEAALEKQRQLAEAHAQAKAQAEREAKELQQRMQ
EEVVRREEAAVDAQQQKRSIQEELQQLRQSSEAEIQAKARQAEAAERSRLRIEEEIRVVRLQLEATERQRGGAEG
ELQALRARAEEAEAQKRQAQEEAERLRRQVQDESQRKRQAEVELASRVKAETEAAREKQRALQALEELRLQAEEA
ERRLRQAEVERARQVQVALETAQRSAEAELQSKRASFAEKTAQLERSLQEEHVAVAQLREEAERRAQQQAEAERA
REEAERELERWQLKANEALRLRLQAEEVAQQKSLAQAEAEKQKEEAEREARRRGKAEEQAVRQRELAEQELEKQR
QLAEGTAQQRLAAEQELIRLRAETEQGEQQRQLLEEELARLQREAAAATQKRQELEAELAKVRAEMEVLLASKAR
AEEESRSTSEKSKQRLEAEAGRFRELAEEAARLRALAEEAKRQRQLAEEDAARQRAEAERVLAEKLAAIGEATRL
KTEAEIALKEKEAENERLRRLAEDEAFQRRRLEEQAAQHKADIEERLAQLRKASDSELERQKGLVEDTLRQRRQV
EEEILALKASFEKAAAGKAELELELGRIRSNAEDTLRSKEQAELEAARQR

FIGURE 589A

```
GGACGGCCATACTATTTTTATCTTGCTTTTTCGTTCTGTCGCAGTACTGTTTAATATGAGTCCAGCGACGGCTCT
GTGACTGTTTTCCTCTGGTAAAATCGCTCTTGCGTCCTCAGCGTTTATCTCAGGTGCGGAAGGTCTCACAGGTTT
GGAAATAGCGCCGGAAAAATCGATCCGCGGAGTGAGACGGCTCGTACCACACTGCAGGGCCCGGAGGTCAAGATG
GTGGCTGTAAAACTAGGATCCCTGACGATTGCTTAGCATTAAGGCCCGACATGGAACCGGGGTGTGACGAGTTCC
TGCCGCCACCGGAGTGCCCGGTTTTTGAGCCTAGCTGGGCTGAATTCCAAGACCCGCTTGGCTACATTGCGAAAA
TAAGGCCCATAGCAGAGAAGTCTGGCATCTGCAAAATCCGCCCACCCGCGGATTGGCAGCCTCCTTTTGCAGTAG
AAGTTGACAATTTCAGATTTACTCCTCGCGTCCAAAGGCTAAATGAACTGGAGGCCCAAACTAGAGTGAAATTGA
ACTATTTGGATCAGATTGCAAAATTCTGGGAAATTCAAGGCTCCTCTTTAAAGATTCCCAATGTGGAGCGGAAGA
TCTTGGACCTCTACAGCCTTAGTAAGATTGTGATTGAGGAAGGTGGCTATGAAGCCATCTGCAAGGATCGTCGGT
GGGCTCGAGTTGCCCAGCGTCTCCACTACCCACCAGGCAAAAACATTGGCTCCCTGCTACGATCACATTACGAAC
GCATTATTACCCCTATGAAATGTTTCAGTCTGGAGCCAACCATGTGCAATGTAACACACACCCGTTTGACAATG
AGGTAAAAGATAAGGAATACAAGCCCCACAGCATCCCCCTTAGACAGTCTGTGCAGCCTTCAAAGTTCAGCAGCT
ACAGTCGACGGGCAAAAAGGCTACAGCCTGATCCAGAGCCTACAGAGGAGGACATTGAGAAGCATCCAGAGCTAA
AGAAGTTACAGATATATGGGCCAGGTCCCAAAATGATGGGCTTGGGCCTTATGGCTAAGGATAAGGATAAGACTG
TGCATAAGAAAGTCACATGCCCCCCAACTGTTACGGTGAAGGATGAGCAAAGTGGAGGTGGGAACGTGTCATCAA
CATTGCTCAAGCAGCACTTGAGCCTAGAGCCCTGCACTAAGACAACCATGCAACTTCGAAAGAATCACAGCAGTG
CCCAGTTTATTGACTCATATATTTGCCAAGTATGCTCCCGTGGGGATGAAGATAATAAGCTTCTTTTCTGTGATG
GCTGTGATGACAATTACCACATCTTCTGCTTGTTACCACCCCTTCCTGAAATCCCCAGAGGCATCTGGAGGTGCC
CAAAATGTATCTTGGCGGAGTGTAAACAGCCTCCTGAAGCTTTTGGATTTGAACAGGCTACCCAGGAGTACAGTT
TGCAGAGTTTTGGTGAAATGGCTGATTCCTTCAAGTCCGACTACTTCAACATGCCTGTACATATGGTGCCTACAG
AACTTGTAGAGAAGGAATTCTGGAGGCTGGTGAGCAGCATTGAGGAAGACGTGACAGTTGAATATGGAGCTGATA
TTCATTCCAAAGAATTTGGCAGTGGCTTTCCTGTCAGCAATAGCAAACAAAACTTATCTCCTGAGGAGAAGGAGT
ATGCGACCAGTGGTTGGAACCTGAATGTGATGCCAGTGCTAGATCAGTCTGTTCTCTGTCACATCAATGCAGACA
TCTCAGGCATGAAGGTGCCCTGGCTGTACGTGGGCATGGTTTTCTCAGCATTTGTTGGCATATTGAGGATCACT
GGAGTTACTCTATTAACTATCTGCATTGGGGTGAGCCGAAGACCTGGTATGGTGTACCCTCCCTGGCAGCAGAGC
ATTTGGAGGAGGTGATGAAGATGCTGACACCTGAGCTGTTTGATAGCCAGCCTGATCTCCTACACCAGCTTGTCA
CTCTCATGAATCCCAACACTTTGATGTCCCATGGTGTGCCAGTTGTCCGCACAAACCAGTGTGCAGGGGAGTTTG
TCATCACTTTTCCTCGTGCTTACCACAGTGGTTTTAACCAAGGCTACAATTTTGCTGAAGCTGTCAACTTTTGTA
CTGCTGACTGGCTACCTGCTGGACGCCAGTGCATTGAACACTACCGCCGGCTCCGGCGCTATTGTGTCTTCTCCC
ACGAGGAGCTCATCTGCAAGATGGCTGCCTTCCCAGAGACGTTGGATCTCAATCTAGCAGTAGCTGTGCACAAGG
AGATGTTCATTATGGTTCAGGAGGAGCGACGTCTACGAAAGGCCCTTTTGGAGAAGGGCGTCACGGAGGCTGAGC
GAGAGGCTTTTGAGCTGCTCCCAGATGATGAACGCCAGTGCATCAAGTGCAAGACCACGTGCTTCTTGTCAGCCC
TGGCCTGCTACGACTGCCCAGATGGCCTTGTATGCCTTTCCCACATCAATGACCTCTGCAAGTGCTCTAGTAGCC
GACAGTACCTCCGGTATCGGTACACCTTGGATGAGCTCCCCACCATGCTGCATAAACTGAAGATTCGGGCTGAGT
CTTTTGACACCTGGGCCAACAAAGTGCGAGTGGCCTTGGAGGTGGAGGATGGCCGTAAACGCAGCTTTGAAGAGC
TAAGGGCACTGGAGTCTGAGGCTCGTGAGAGGAGGTTTCCTAATAGTGAGCTGCTTCAGCGACTGAAGAACTGCC
TGAGTGAGGTGGAGGCTTGTATTGCTCAAGTCCTGGGGCTGGTCAGTGGTCAGGTGGCCAGGATGGACACTCCAC
AGCTGACTTTGACTGAACTCCGGGTCCTTCTTGAGCAGATGGGCAGCCTGCCCTGCGCCATGCATCAGATTGGGG
ATGTCAAGGATGTCCTGGAACAGGTGGAGGCCTATCAAGCTGAGGCTCGTGAGGCTCTGGCCACACTGCCCTCTA
GTCCAGGGCTATTGCGGTCCCTGTTGGAGAGGGGCAGCAGCTGGGTGTAGAGGTGCCTGAAGCCCATCAGCTTC
AGCAGCAGGTGGAGCAGGCGCAATGGCTAGATGAAGTGAAGCAGGCCCTGGCCCCTTCTGCTCACAGGGGCTCTC
TGGTCATCATGCAGGGGCTTTTGGTTATGGGTGCCAAGATAGCCTCCAGCCCTTCTGTGGACAAGGCCCGGGCTG
AGCTGCAAGAACTACTGACCATTGCAGAGCGCTGGGAAGAAAAGGCTCATTTCTGCCTGGAGGCCAGGCAGAAGC
ATCCACCAGCCACATTGGAAGCCATAATTCGTGAGACAGAAAACATCCCTGTTCACCTGCCTAACATCCAGGCTC
TCAAAGAAGCTCTGACTAAGGCACAAGCTTGGATTGCTGATGTGGATGAGATCCAAAATGGTGACCACTACCCCT
GTCTAGATGACTTGGAGGGCCTGGTGGCTGTGGGCCGGGACCTGCCTGTGGGCTGGAAGAGCTGAGACAGCTAG
AGCTGCAGGTATTGACAGCACATTCCTGGAGAGAGAAGGCCTCCAAGACCTTTCTCAAGAAGAATTCTTGCTACA
CACTGCTTGAGGTGCTTTGCCCGTGTGCAGACGCTGGCTCAGACAGCACCAAGCGTAGCCGGTGGATGGAGAAGG
```

FIGURE 589B

```
CGCTGGGGTTGTACCAGTGTGACACAGAGCTGCTGGGGCTGTCTGCACAGGACCTCAGAGACCCAGGCTCTGTGA
TTGTGGCCTTCAAGGAAGGGGAACAGAAGGAGAAGGAGGGTATCCTGCAGCTGCGTCGCACCAACTCAGCCAAGC
CCAGTCCACTGGCACCATCCCTCATGGCCTCTTCTCCAACTTCTATCTGTGTGTGTGGGCAGGTGCCAGCTGGGG
TGGGACTTCTGCAGTGTGACCTGTGTCAGGACTGGTTCCATGGGCAGTGTGTGTCAGTGCCCCATCTCCTCACCT
CTCCAAAGCCCAGTCTCACTTCATCTCCACTGCTAGCCTGGTGGGAATGGGACACAAAATTCCTGTGTCCACTGT
GTATGCGCTCACGACGGCCACGCCTAGAGACAATCCTAGCCTTGCTGGTTGCCCTGCAGAGGCTGCCCGTGCGGC
TGCCTGAGGGTGAGGCCCTTCAGTGTCTCACAGAGAGGGCCATTGGCTGGCAAGACCGTGCCAGAAAGGCTCTGG
CCTTTGAAGATGTGACTGCTCTGTTGCGACAGCTGGCTGAGCTTCGCCAACAGCTACAGGCCAAACCCAGACCAG
AGGAGGCCTCAGTCTACACTTCAGCCACTGCCTGTGACCCTATCAGAGAAGGCAGTGGCAACAATATTTCTAAGG
TCCAAGGGCTGCTGGAGAATGGAGACAGTGTGACCAGTCCTGAGAACATGGCTCCAGGAAAGGGCTCTGACCTGG
AGCTACTGTCCTCGCTGTTGCCGCAGTTGACTGGCCCTGTGTTGGAGCTGCCTGAGGCAATCCGGGCTCCCCTGG
AGGAGCTCATGATGGAAGGGGGCCTGCTTGAGGTGACCCTGGATGAGAACCACAGCATCTGGCAGCTGCTGCAGG
CTGGACAGCCTCCAGACCTGGACAGAATTCGCACACTTCTGGAGCTGGAAAAATTTGAACATCAAGGGAGTCGGA
CAAGGAGCCGGGCTCTGGAGAGGCGACGGCGGCGGCAGAAGGTGGATCAGGGTAGAAACGTTGAGAATCTTGTTC
AACAGGAGCTTCAGTCAAAAAGGGCTCGGAGCTCAGGGATTATGTCTCAGGTGGGCCGAGAAGAAGAACATTATC
AGGAGAAAGCAGACCGTGAAAATATGTTCCTGACACCTTCCACAGACCACAGCCCTTTCTTGAAAGGAAACCAAA
ATAGCTTACAACACAAGGATTCAGGCTCTTCAGCTGCTTGTCCTTCTTTAATGCCTTTGCTACAACTCTCCTACT
CTGATGAGCAACAGTTGTGACAGTGGCACCAAAGGTCATTTGTGGTTGTTTTTGTTTGTTTGTTTCTTAAATCCT
ACTATCTCCTGGCCTGGACCTCAGAAGGAGCTTTTGCCTATCTATAATTTTTCACTGCCAATTTTTGATATCCT
CTCTCCTAGAGTTACTGTTAAAAGGTTGGTTCGTAAAGTCCACACCCCGATGCTCAGAAGTGTCTTGCCAGCAAC
ATTCCTGCTAGCATACAGGAGTGATTTCCTAAACCAGTTTCATTCTAGTCTGAATAGGGACAAACAAATCTTGAG
GAAGCCCAAGTGCGTACCTTTATTTTTGCCCCCACCACCCTCTTTCTGTACTTCAATTTTTGTTTGTTTTTGTT
TTTTTGTCCCTGTCATAAAATATTTTGGTGCTTCAAAACTTGTACCTTCATTGTACATCCTTTTCTTTTCTCCCC
TTGGGTCTTATTATAAAAGAAGACAATGTACGTTGTAATTACCAAAAAGAATAGGGAAAAACAAGAATTTCATGA
CTCTACCTGTGGTCTATCTTTAATTTCATTTCTTTTGTTAAAAATAAAACAATGAGTATGTTTGGGAAAAAAAAA
A
```

FIGURE 590

MEPGCDEFLPPPECPVFEPSWAEFQDPLGYIAKIRPIAEKSGICKIRPPADWQPPFAVEVDNFRFTPRVQRLNEL
EAQTRVKLNYLDQIAKFWEIQGSSLKIPNVERKILDLYSLSKIVIEEGGYEAICKDRRWARVAQRLHYPPGKNIG
SLLRSHYERIIYPYEMFQSGANHVQCNTHPFDNEVKDKEYKPHSIPLRQSVQPSKFSSYSRRAKRLQPDPEPTEE
DIEKHPELKKLQIYGPGPKMMGLGLMAKDKDKTVHKKVTCPPTVTVKDEQSGGGNVSSTLLKQHLSLEPCTKTTM
QLRKNHSSAQFIDSYICQVCSRGDEDNKLLFCDGCDDNYHIFCLLPPLPEIPRGIWRCPKCILAECKQPPEAFGF
EQATQEYSLQSFGEMADSFKSDYFNMPVHMVPTELVEKEFWRLVSSIEEDVTVEYGADIHSKEFGSGFPVSNSKQ
NLSPEEKEYATSGWNLNVMPVLDQSVLCHINADISGMKVPWLYVGMVFSAFCWHIEDHWSYSINYLHWGEPKTWY
GVPSLAAEHLEEVMKMLTPELFDSQPDLLHQLVTLMNPNTLMSHGVPVVRTNQCAGEFVITFPRAYHSGFNQGYN
FAEAVNFCTADWLPAGRQCIEHYRRLRRYCVFSHEELICKMAAFPETLDLNLAVAVHKEMFIMVQEERRLRKALL
EKGVTEAEREAFELLPDDERQCIKCKTTCFLSALACYDCPDGLVCLSHINDLCKCSSSRQYLRYRYTLDELPTML
HKLKIRAESFDTWANKVRVALEVEDGRKRSFEELRALESEARERRFPNSELLQRLKNCLSEVEACIAQVLGLVSG
QVARMDTPQLTLTELRVLLEQMGSLPCAMHQIGDVKDVLEQVEAYQAEAREALATLPSSPGLLRSLLERGQQLGV
EVPEAHQLQQQVEQAQWLDEVKQALAPSAHRGSLVIMQGLLVMGAKIASSPSVDKARAELQELLTIAERWEEKAH
FCLEARQKHPPATLEAIIRETENIPVHLPNIQALKEALTKAQAWIADVDEIQNGDHYPCLDDLEGLVAVGRDLPV
GLEELRQLELQVLTAHSWREKASKTFLKKNSCYTLLEVLCPCADAGSDSTKRSRWMEKALGLYQCDTELLGLSAQ
DLRDPGSVIVAFKEGEQKEKEGILQLRRTNSAKPSPLAPSLMASSPTSICVCGQVPAGVGLLQCDLCQDWFHGQC
VSVPHLLTSPKPSLTSSPLLAWWEWDTKFLCPLCMRSRRPRLETILALLVALQRLPVRLPEGEALQCLTERAIGW
QDRARKALAFEDVTALLRQLAELRQQLQAKPRPEEASVYTSATACDPIREGSGNNISKVQGLLENGDSVTSPENM
APGKGSDLELLSSLLPQLTGPVLELPEAIRAPLEELMMEGGLLEVTLDENHSIWQLLQAGQPPDLDRIRTLLELE
KFEHQGSRTRSRALERRRRRQKVDQGRNVENLVQQELQSKRARSSGIMSQVGREEEHYQEKADRENMFLTPSTDH
SPFLKGNQNSLQHKDSGSSAACPSLMPLLQLSYSDEQQL

FIGURE 591

ACACTCGCTTCTGGAACGTCTGAGATTATCAATAAGCTCCTAGTCCAGACGCCATGGGTCATTTCACAGAGGAGG
ACAAGGCTACTATCACAAGCCTGTGGGGCAAGGTGAATGTGGAAGATGCTGGAGGAGAAACCCTGGGAAGGCTCC
TGGTTGTCTACCCATGGACCCAGAGGTTCTTTGACAGCTTTGGCAACCTGTCCTCTGCCTCTGCCATCATGGGCA
ACCCCAAAGTCAAGGCACATGGCAAGAAGGTGCTGACTTCCTTGGGAGATGCCATAAAGCACCTGGATGATCTCA
AGGGCACCTTTGCCCAGCTGAGTGAACTGCACTGTGACAAGCTGCATGTGGATCCTGAGAACTTCAAGCTCCTGG
GAAATGTGCTGGTGACCGTTTTGGCAATCCATTTCGGCAAAGAATTCACCCCTGAGGTGCAGGCTTCCTGGCAGA
AGATGGTGACTGCAGTGGCCAGTGCCCTGTCCTCCAGATACCACTGAGCCTCTTGCCCATGATTCAGAGCTTTCA
AGGATAGGCTTTATTCTGCAAGCAATACAAATAATAAATCTATTCTGCTGAGAGATCAC

FIGURE 592

MGHFTEEDKATITSLWGKVNVEDAGGETLGRLLVVYPWTQRFFDSFGNLSSASAIMGNPKVKAHGKKVLTSLGDA
IKHLDDLKGTFAQLSELHCDKLHVDPENFKLLGNVLVTVLAIHFGKEFTPEVQASWQKMVTAVASALSSRYH

FIGURE 593

CAGAGTTTCGCCATGGCCCGGGGCCCCAAGAAGCACTTAAAGCGTGTTGCAGCGCCGAAGCATTGGATGCTTGAC
AAACTAACGGGTGTATTTGCACCTCGTCCATCGACAGGTCCCCACAAGCTGAGGGAATGTCTTCCTCTGATCGTC
TTCCTCAGGAATAGACTCAAGTATGCGTTGACTGGAGATGAGGTAAAGAAGATATGTATGCAACGTTTCATCAAA
ATTGATGGCAAGGTTCGAGTGGATGTCACATACCCTGCTGGATTCATGGATGTCATCAGCATCGAGAAGACAGGT
GAACATTTCCGCCTGGTCTATGACACCAAGGGCCGTTTTGCTGTTCACCGCATCACAGTGGAAGAGGCAAAGTAC
AAGTTGTGCAAAGTGAGGAAGATTACTGTGGGAGTGAAGGGAATCCCTCACCTGGTGACTCATGATGCTCGAACC
ATCCGCTACCCAGATCCTGTCATCAAGGTGAACGATACTGTGCAGATTGATTTAGGGACTGGCAAGATAATCAAC
TTTATCAAATTTGATACAGGCAATTTGTGTATGGTGATTGGTGGAGCCAACCTCGGTCGTGTTGGTGTGATCACC
AACAGGGAAAGACATCCTGGTTCTTTTGATGTGGTGCATGTGAAGGATGCCAATGGCAACAGCTTTGCCACGAGG
CTTTCCAACATTTTTGTCATTGGCAATGGCAATAAACCTTGGATTTCCCTGCCCAGGGGAAAGGGCATTCGACTT
ACTGTTGCTGAAGAGAGAGATAAGAGGCTGGCCACCAAACAGAGCAGTGGCTAAATTGCAGTAGCAGCATATCTT
TTTTCTTTGCACAAATAAACAGTGAATTCTCGTTTAAAAAAAAAAAAAAAAAAAAAAAAAAAAAAAAAAAAAAAA
AAAAAAAAAAAAAAAAAAAAAAAAAAAAAA

FIGURE 594

MARGPKKHLKRVAAPKHWMLDKLTGVFAPRPSTGPHKLRECLPLIVFLRNRLKYALTGDEVKKICMQRFIKIDGK
VRVDVTYPAGFMDVISIEKTGEHFRLVYDTKGRFAVHRITVEEAKYKLCKVRKITVGVKGIPHLVTHDARTIRYP
DPVIKVNDTVQIDLGTGKIINFIKFDTGNLCMVIGGANLGRVGVITNRERHPGSFDVVHVKDANGNSFATRLSNI
FVIGNGNKPWISLPRGKGIRLTVAEERDKRLATKQSSG

FIGURE 595A

```
CCAGTGTAAGAGTTCCGCTATTCGGTCTCACACCTACAGTGGACTACCCGATTTTCGCTTCTCTTCAGGGATGA
GTCATGTGGTGGTGAAAAATGACCCTGAACTGGACCAGCAGCTTGCTAATCTGGACCTGAACTCTGAAAAACAGA
GTGGAGGAGCAAGTACAGCGAGCAAAGGGCGCTATATACCTCCTCACTTAAGGAACAGAGAAGCATCTAAAGGAT
TCCATGATAAAGACAGTTCAGGTTGGAGTTGCAGCAAAGATAAGGATGCATATAGCAGTTTGGGTCTCGAGATT
CTAGAGGAAAGCCTGGTTATTTCAGTGAACGTGGAAGTGGATCAAGGGGAAGATTTGATGATCGTGGACGGAGTG
ACTATGATGGTATTGGCAATCGTGAAAGACCTGGCTTTGGCAGATTTGAACGGAGTGGACATAGTCGTTGGTGTG
ACAAGTCAGTTGAAGATGATTGGTCAAAACCACTTCCACCAAGTGAACGCTTGGAGCAAGAACTGTTTTCTGGAG
GAAACACGGGGATTAACTTTGAGAAATATGATGATATACCAGTAGAGGCAACCGGCAGTAACTGTCCTCCACATA
TTGAGAATTTTAGCGATATTGACATGGGAGAAATTATCATGGGAACATTGAACTTACTCGCTATACTCGTCCTA
CTCCAGTGCAAAAACATGCCATTCCTATTATTAAGGGAAAAAGAGACTTAATGGCTTGTGCCCAAACAGGATCTG
GGAAAACTGCAGCATTTCTTTTACCCATACTGAGTCAGATATATACAGATGGTCCAGGAGAAGCTTTGAAGGCTG
TGAAGGAAAATGGAAGGTATGGGCGCCGCAAACAATATCCAATATCCTTGGTTTTAGCCCCAACAAGAGAATTGG
CTGTACAGATCTATGAGGAAGCCAGAAAATTTTCCTACCGATCTAGAGTTCGTCCTTGTGTAGTTTATGGTGGTG
CTGATATTGGTCAGCAGATTCGGGACTTAGAACGTGGATGCCACTTGTTAGTAGCCACTCCAGGACGTCTAGTGG
ATATGATGGAAAGAGGAAAGATTGGATTAGACTTCTGCAAGTACTTAGTGTTGGATGAAGCTGATAGGATGCTGG
ATATGGGATTTGAACCTCAGATACGTCGTATAGTTGAACAAGATACTATGCCACCAAAGGGCGTTCGTCACACCA
TGATGTTTAGTGCTACTTTTCCTAAGGAAATACAGATGCTTGCTCGTGACTTTTTGGATGAATATATCTTTTTGG
CTGTAGGCAGAGTAGGCTCTACCTCTGAGAACATCACACAGAAAGTAGTTTGGGTGGAAGACTTAGATAAACGGT
CATTTCTACTGGACATTTTAGGTGCAACAGGGAGTGATTCACTTACTTTAGTGTTTGTGGAGACCAAAAAGGGAG
CAGATTCCCTGGAGGATTTCTTATACCATGAAGGATATGCTTGTACTAGTATTCATGGAGACCGGTCACAGAGAG
ATCGAGAGGAGGCCCTTCACCAGTTTCGCTCAGGAAAAAGCCCAATTCTAGTGGCTACAGCTGTGGCAGCACGAG
GACTAGACATTTCAAATGTGAGACATGTTATCAATTTTGATTTGCCAAGTGATATTGAAGAATATGTGCATCGTA
TTGGCCGTACAGGACGTGTAGGAAACCTGGGCCTTGCCACCTCATTCTTTAATGAAAAAAATATGAATATTACAA
AGGATTTGTTGGATCTTCTTGTAGAAGCTAAACAAGAAGTGCCTTCTTGGTTGGAAAATATGGCTTATGAACACC
ACTACAAGGGTGGCAGTCGTGGACGATCTAAAAGTAATAGATTCAGTGGAGGATTTGGTGCCAGAGACTATCGAC
AAAGTAGTGGTTCCAGCAGTTCTGGCTTTGGTGCTAGTCGCGGAAGCAGCAGCCGCAGTGGTGGAGGTGGTTACG
GCAACAGCAGAGGATTTGGTGGAGGTGGCTATGGAGGCTTCTACAATAGTGATGGATATGGAGGAAATTATAACT
CCCAGGGGGTTGACTGGTGGGGCAACTGAATCTGCTTTGCAGCAAAGTCACCCTTACAAAGAAGCTAATATGGAA
ACCACATGTAACTTAGCCAGACTATATTGTGTAGCTTCAAGAACTTGCAGTACATTACCAGCTGTGATTCTCCTG
ATAATTCAAGGGAGCTCAAAGTCACAAGAAGAAAAATGAAAGGAAAAAACAGCAGCCCTATTCAGAAATTGGTTT
GAAGATGTAATTGCTCTAGTTTGGATTAAACTCTTCCCCTCCTGCTTTAGTGCCACCCCAAACTGCATTTATAAT
TTTGTGACTGAGGATCGTTTGTTTGTTAACGTACTGTGACTTTAACTTTAGACAACTTACTACTTTGATGTCCTG
TTGGCTCAGTAATGCTCACGATACCAATTGTTTTGACAAAATAAATTTACTAAACTTGGCCTAAAATCAAACCTT
GGCACAGAGGTATGATACAACTTTAACAGGAGTCATCAATTCATCCATAAATATAAAAAGGGAAAAAAACTTAAG
GCAGTAGTCTGCATTAGGACTGTTTGAGTTTTGCAGACTTGGGGTTGGGAGAACATCTTAAAGCATTAAAGCATA
GTTTTTTGTATGGCCAACCTTACTAAATTAAGTTCTGACTTGCTCACTCTATCCTGGATAGGCACTTGGGAACTT
ACACTCTTTAAGCCATTCCAGTCATGATGAGGTGGAATGTATCAGTATACCAATTAATATTTTGAAAGAGTTCT
TTTAGGTTAATTTAAGTACAGCAATTTCTCATGTAATGTTTAGGGAGTTTATTCTAACCTAGGCAAACGGCATGC
TATCACAAGAAAGGTTTAAAGCTTTGATAAAATGGGGGAGATTTAATCAGTTTTTTAATGCCTGCTATAAAAAT
TTGAAATATTAGAATGGCCGACCATGGCAGTGACCAGGCCTCACTACAGGCCTGGTTGGATTCTGGTCTTTAATG
CATGCTAGTGTTGATGTTTTTGGTCAAGAACGGTTTAAACAGGAAGGATTGTGCAGCAGGCTTTAATTTAATGT
AGATTCATACTGCTCTGTTAAAGCTGCATTGAAATGTTAAAATGGCTTACACTTGCAGACTTTGCAAATCTTAAG
ACTAACAAATCCTTGAAATCACACAGCTTGCAAATACGTACTAAACTGCACAAGGTGTGTGTTCTATATGTGCAG
TTTTAGCGTATTTTAGTTGCATAGGTTTCCATGGTATTTATAGTCTCTTGTGCTAAATTTGGCCAAAGATGATTG
TCCACCACTAAAAATGCCTCTCCCACTTGGAATTCTGTACTGATTTGTGGCCAGATGCAATGATCTTTAAAAAC
AAATCTTTTCAATGGCATAAGAAGTTGACAAAAATTTCTTAAAGTGCAATAGATTTTCAAGTTATTGTGCCTTGT
TCTAAAATTTTAAGTAGGGCACTTGACAGTATTGAGGTCATTTGTTAAGGTGCTATTTCAATTAGTGTAGGTTTA
GACTCTTGTACATTTCTCCCATAACTTTTTACAAAGTATTTTGTTGCACATTCAGAGAATTTTATATATATATGT
```

FIGURE 595B

```
CTTGTGTGGGTGTCCTCGACCTTCCAATCTTATTTCGTCTCTTGGAGATTGTTGAATGCAGCCAGTGAAGAAGTA
GATTCCTAAATTTTATTGGGGACCATGGAATGGTAGTTGAGAAGAAAACTATTTGCACACAACAGATTTTAGATA
CTTTTTGCTGCTAGTTGTGTAATATTTATTGAACATTTTGACAAATATTTATTTTTGTAAGCCTAAAAATGATTC
TTTGAAAGTTTAAAGAAACTTGACCAAAAGACAGTACAAAAAACACTGGCACTTGAATGTTGAATGTCACCGTAT
GTGAAATAATATATTTTGGGGTAGTGTGAGCTTTTAATGTTAAGTCTGTTAAACTTGAGTCAAATTAAGCAGACC
CGGCATTGGCAATGTAGCTGTAATTTTCTGACAAAATTTAAGACAAAATTGTCAACTTGAAACTAAAACATGCCA
AGGTTTTGATATACTTGTCTTAAGATATTAATGAAACAATTTTGAACACTGATAGGAAGGTCCACATCCACAAAG
TTTCTCTTGAGTTTTGTTATGTGTTTTGCTGTGTTTGATTTTCAGTGATTGTCTGGTATATTTACAGTCCTCAAA
CATGGTTATTTCTGTCAGTGACTTAACATTCGGTTTTACCAGCCAGCAGTATTCTTCAGTAAATAAAGAATGGAA
TTGCTGAATGTAATCATTGAACCTCGAGTCACTGTAAAAGTTCAGTAATTGCTTATTGTATTAGTTTTAGATGCT
GGCACCGCATGTGCTCTGTTTATTCTGATTTTACTAAAATAAAAAGTTCAAAAGTCAAAAAAAAAA
```

FIGURE 596

MSHVVVKNDPELDQQLANLDLNSEKQSGGASTASKGRYIPPHLRNREASKGFHDKDSSGWSCSKDKDAYSSFGSR
DSRGKPGYFSERGSGSRGRFDDRGRSDYDGIGNRERPGFGRFERSGHSRWCDKSVEDDWSKPLPPSERLEQELFS
GGNTGINFEKYDDIPVEATGSNCPPHIENFSDIDMGEIIMGNIELTRYTRPTPVQKHAIPIIKGKRDLMACAQTG
SGKTAAFLLPILSQIYTDGPGEALKAVKENGRYGRRKQYPISLVLAPTRELAVQIYEEARKFSYRSRVRPCVVYG
GADIGQQIRDLERGCHLLVATPGRLVDMMERGKIGLDFCKYLVLDEADRMLDMGFEPQIRRIVEQDTMPPKGVRH
TMMFSATFPKEIQMLARDFLDEYIFLAVGRVGSTSENITQKVVWVEDLDKRSFLLDILGATGSDSLTLVFVETKK
GADSLEDFLYHEGYACTSIHGDRSQRDREEALHQFRSGKSPILVATAVAARGLDISNVRHVINFDLPSDIEEYVH
RIGRTGRVGNLGLATSFFNEKNMNITKDLLDLLVEAKQEVPSWLENMAYEHHYKGGSRGRSKSNRFSGGFGARDY
RQSSGSSSSGFGASRGSSSRSGGGGYGNSRGFGGGGYGGFYNSDGYGGNYNSQGVDWWGN

US 7,749,695 B2

PRO POLYPEPTIDES FOR DIAGNOSIS OF SYSTEMIC LUPUS ERYTHEMATOSIS

FIELD OF THE INVENTION

The present invention relates to compositions and methods useful for the diagnosis and treatment of systemic lupus erythematosis.

BACKGROUND OF THE INVENTION

Immune related and inflammatory diseases are the manifestation or consequence of fairly complex, often multiple interconnected biological pathways which in normal physiology are critical to respond to insult or injury, initiate repair from insult or injury, and mount innate and acquired defense against foreign organisms. Disease or pathology occurs when these normal physiological pathways cause additional insult or injury either as directly related to the intensity of the response, as a consequence of abnormal regulation or excessive stimulation, as a reaction to self, or as a combination of these.

Though the genesis of these diseases often involves multi-step pathways and often multiple different biological systems/pathways, intervention at critical points in one or more of these pathways can have an ameliorative or therapeutic effect. Therapeutic intervention can occur by either antagonism of a detrimental process/pathway or stimulation of a beneficial process/pathway.

Many immune related diseases are known and have been extensively studied. Such diseases include immune-mediated inflammatory diseases, non-immune-mediated inflammatory diseases, infectious diseases, immunodeficiency diseases, neoplasia, etc.

Immune related diseases could be treated by suppressing the immune response. Using neutralizing antibodies that inhibit molecules having immune stimulatory activity would be beneficial in the treatment of immune-mediated and inflammatory diseases. Molecules which inhibit the immune response can be utilized (proteins directly or via the use of antibody agonists) to inhibit the immune response and thus ameliorate immune related disease.

Systemic Lupus Erythematosus (SLE) is an autoimmune diseases characterized by chronic relapsing inflammation of various tissue sites, primarily kidney, which result in tissue destruction. SLE is more common in women and genetic susceptibility is thought to contribute to the dysregulation of the immune system. Animal studies as well as human clinical experience have also demonstrated that environmental factors also contribute to these diseases. While the etiology and pathogenesis of SLE is still poorly understood, B cells, T cells and monocytes have all been implicated as playing critical roles in disease progression. Therapeutics know to target these cell types have been shown to impact disease progression in human as well as animal studies. Analysis of the gene expression patterns of white blood cells from healthy individuals compared to SLE patients was carried out using Affymetrix® GeneChips®. The identification of genes that are differentially expressed in disease vs healthy cells is likely to provide important information as to the role of these gene products in the pathogenesis of disease. These disease associated genes may be used as targets or therapies for the treatment of SLE and other autoimmune mediated inflammatory diseases and may include the gene products themselves as well as antibody, peptide or small molecule antagonists. The identification of genes that are differentially expressed in disease vs healthy cells is likely to provide important information as to the role of these gene products in the pathogenesis of disease. These disease associated genes may be used as targets or therapies for the treatment of SLE and other autoimmune mediated inflammatory diseases and may include the gene products themselves as well as antibody, peptide or small molecule antagonists.

SUMMARY OF THE INVENTION

A. Embodiments

The present invention concerns compositions and methods useful for the diagnosis and treatment of SLE in mammals, including humans. The present invention is based on the identification of proteins (including agonist and antagonist antibodies) which are a result of stimulation of the immune response in mammals, resulting in autoimmunity. Immune related diseases can be treated by suppressing or enhancing the immune response. Molecules that enhance the immune response stimulate or potentiate the immune response to an antigen. Molecules which stimulate the immune response can be used therapeutically where enhancement of the immune response would be beneficial. Alternatively, molecules that suppress the immune response attenuate or reduce the immune response to an antigen (e.g., neutralizing antibodies) can be used therapeutically where attenuation of the immune response would be beneficial (e.g., inflammation). Accordingly, the PRO polypeptides, agonists and antagonists thereof are also useful to prepare medicines and medicaments for the treatment of SLE. In a specific aspect, such medicines and medicaments comprise a therapeutically effective amount of a PRO polypeptide, agonist or antagonist thereof with a pharmaceutically acceptable carrier. Preferably, the admixture is sterile.

In a further embodiment, the invention concerns a method of identifying agonists or antagonists to a PRO polypeptide which comprises contacting the PRO polypeptide with a candidate molecule and monitoring a biological activity mediated by said PRO polypeptide. Preferably, the PRO polypeptide is a native sequence PRO polypeptide. In a specific aspect, the PRO agonist or antagonist is an anti-PRO antibody.

In another embodiment, the invention concerns a composition of matter comprising a PRO polypeptide or an agonist or antagonist antibody which binds the polypeptide in admixture with a carrier or excipient. In one aspect, the composition comprises a therapeutically effective amount of the polypeptide or antibody.

In a further aspect, when the composition comprises an immune inhibiting molecule, the composition is useful for: (a) inhibiting or reducing SLE in a mammal in need thereof, (b) decreasing the activity of immune cells or (c) decreasing the proliferation of immune cells in a mammal in need thereof in response to an antigen. In another aspect, the composition comprises a further active ingredient, which may, for example, be a further antibody or a cytotoxic or chemotherapeutic agent. Preferably, the composition is sterile.

In another embodiment, the invention concerns a method of treating an immune related disorder in a mammal in need thereof, comprising administering to the mammal an effective amount of a PRO polypeptide, an agonist thereof, or an antagonist thereto. In a preferred aspect, the immune related disorder is selected from the group consisting of SLE rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune or immune-mediated skin diseases including bullous skin diseases, erythema multiforme and contact dermatitis, psoriasis, lymphadenopathy, splenomegaly and leukopenia In another embodiment, the invention provides an antibody which specifically binds to any of the above or below described polypeptides. Optionally, the antibody is a monoclonal antibody, humanized antibody, antibody fragment or single-chain antibody. In one aspect, the present invention concerns an isolated antibody which binds a PRO polypeptide. In another aspect, the antibody mimics the activity of a PRO polypeptide (an agonist antibody) or conversely the antibody inhibits or neutralizes the activity of a PRO polypeptide (an antagonist antibody). In another aspect, the antibody is a monoclonal antibody, which preferably has nonhuman complementarity determining region (CDR) residues and human framework region (FR) residues. The antibody may be labeled and may be immobilized on a solid support In a further aspect, the antibody is an antibody fragment, a monoclonal antibody, a single-chain antibody, or an anti-idiotypic antibody.

In yet another embodiment, the present invention provides a composition comprising an anti-PRO antibody in admixture with a pharmaceutically acceptable carrier. In one aspect, the composition comprises a therapeutically effective amount of the antibody. Preferably, the composition is sterile. The composition may be administered in the form of a liquid pharmaceutical formulation, which may be preserved to achieve extended storage stability. Alternatively, the antibody is a monoclonal antibody, an antibody fragment, a humanized antibody, or a single-chain antibody.

In a further embodiment, the invention concerns an article of manufacture, comprising:

(a) a composition of matter comprising a PRO polypeptide or agonist or antagonist thereof;

(b) a container containing said composition; and (c) a label affixed to said container, or a package insert included in said container referring to the use of said PRO polypeptide or agonist or antagonist thereof in the treatment of an immune related disease. The composition may comprise a therapeutically effective amount of the PRO polypeptide or the agonist or antagonist thereof.

In yet another embodiment, the present invention concerns a method of diagnosing SLE in a mammal, comprising detecting the level of expression of a gene encoding a PRO polypeptide (a) in a test sample of tissue cells obtained from the mammal, and (b) in a control sample of known normal tissue cells of the same cell type, wherein a higher or lower expression level in the test sample as compared to the control sample indicates the presence of immune related disease in the mammal from which the test tissue cells were obtained.

In another embodiment, the present invention concerns a method of diagnosing SLE in a mammal, comprising (a) contacting an anti-PRO antibody with a test sample of tissue cells obtained from the mammal, and (b) detecting the formation of a complex between the antibody and a PRO polypeptide, in the test sample; wherein the formation of said complex is indicative of the presence or absence of said disease. The detection may be qualitative or quantitative, and may be performed in comparison with monitoring the complex formation in a control sample of known normal tissue cells of the same cell type. A larger quantity of complexes formed in the test sample indicates the presence or absence of an immune disease in the mammal from which the test tissue cells were obtained. The antibody preferably carries a detectable label. Complex formation can be monitored, for example, by light microscopy, flow cytometry, fluorimetry, or other techniques known in the art. The test sample is usually obtained from an individual suspected of having SLE.

In another embodiment, the invention provides a method for determining the presence of a PRO polypeptide in a sample comprising exposing a test sample of cells suspected of containing the PRO polypeptide to an anti-PRO antibody and determining the binding of said antibody to said cell sample. In a specific aspect, the sample comprises a cell suspected of containing the PRO polypeptide and the antibody binds to the cell. The antibody is preferably detectably labeled and/or bound to a solid support.

In another embodiment, the present invention concerns an immune-related disease diagnostic kit, comprising an anti-PRO antibody and a carrier in suitable packaging. The kit preferably contains instructions for using the antibody to detect the presence of the PRO polypeptide. Preferably the carrier is pharmaceutically acceptable.

In another embodiment, the present invention concerns a diagnostic kit, containing an anti-PRO antibody in suitable packaging. The kit preferably contains instructions for using the antibody to detect the PRO polypeptide.

In another embodiment, the invention provides a method of diagnosing SLE in a mammal which comprises detecting the presence or absence or a PRO polypeptide in a test sample of tissue cells obtained from said mammal wherein the presence or absence of the PRO polypeptide in said test sample is indicative of the presence of SLE in said mammal.

In another embodiment, the present invention concerns a method for identifying an agonist of a PRO polypeptide comprising:

(a) contacting cells and a test compound to be screened under conditions suitable for the induction of a cellular response normally induced by a PRO polypeptide; and (b) determining the induction of said cellular response to determine if the test compound is an effective agonist, wherein the induction of said cellular response is indicative of said test compound being an effective agonist.

In another embodiment, the invention concerns a method for identifying a compound capable of inhibiting the activity of a PRO polypeptide comprising contacting a candidate compound with a PRO polypeptide under conditions and for a time sufficient to allow these two components to interact and determining whether the activity of the PRO polypeptide is inhibited. In a specific aspect, either the candidate compound or the PRO polypeptide is immobilized on a solid support. In another aspect, the non-immobilized component carries a detectable label. In a preferred aspect, this method comprises the steps of:

(a) contacting cells and a test compound to be screened in the presence of a PRO polypeptide under conditions suitable for the induction of a cellular response normally induced by a PRO polypeptide; and (b) determining the induction of said cellular response to determine if the test compound is an effective antagonist.

In another embodiment, the invention provides a method for identifying a compound that inhibits the expression of a PRO polypeptide in cells that normally express the polypeptide, wherein the method comprises contacting the cells with a test compound and determining whether the expression of the PRO polypeptide is inhibited. In a preferred aspect, this method comprises the steps of:

(a) contacting cells and a test compound to be screened under conditions suitable for allowing expression of the PRO polypeptide; and (b) determining the inhibition of expression of said polypeptide.

In yet another embodiment, the present invention concerns a method for treating SLE in a mammal that suffers therefrom comprising administering to the mammal a nucleic acid molecule that codes for either (a) a PRO polypeptide, (b) an agonist of a PRO polypeptide or (c) an antagonist of a PRO polypeptide, wherein said agonist or antagonist may be an anti-PRO antibody. In a preferred embodiment, the mammal is human. In another preferred embodiment, the nucleic acid is administered via ex vivo gene therapy. In a further preferred embodiment, the nucleic acid is comprised within a vector, more preferably an adenoviral, adeno-associated viral, lentiviral or retroviral vector.

In yet another aspect, the invention provides a recombinant viral particle comprising a viral vector consisting essentially of a promoter, nucleic acid encoding (a) a PRO polypeptide, (b) an agonist polypeptide of a PRO polypeptide, or (c) an antagonist polypeptide of a PRO polypeptide, and a signal sequence for cellular secretion of the polypeptide, wherein the viral vector is in association with viral structural proteins. Preferably, the signal sequence is from a mammal, such as from a native PRO polypeptide.

In a still further embodiment, the invention concerns an ex vivo producer cell comprising a nucleic acid construct that expresses retroviral structural proteins and also comprises a retroviral vector consisting essentially of a promoter, nucleic acid encoding (a) a PRO polypeptide, (b) an agonist polypeptide of a PRO polypeptide or (c) an antagonist polypeptide of a PRO polypeptide, and a signal sequence for cellular secretion of the polypeptide, wherein said producer cell packages the retroviral vector in association with the structural proteins to produce recombinant retroviral particles.

In a still further embodiment, the invention provides a method of alleviating SLE in a mammal comprising administering to said mammal (a) a PRO polypeptide, (b) an agonist of a PRO polypeptide, or (c) an antagonist of a PRO polypeptide, wherein SLE in the mammal is alleviated.

B. Additional Embodiments

In other embodiments of the present invention, the invention provides vectors comprising DNA encoding any of the herein described polypeptides. Host cell comprising any such vector are also provided. By way of example, the host cells may be CHO cells, *E. coli*, or yeast. A process for producing any of the herein described polypeptides is further provided and comprises culturing host cells under conditions suitable for expression of the desired polypeptide and recovering the desired polypeptide from the cell culture.

In other embodiments, the invention provides chimeric molecules comprising any of the herein described polypeptides fused to a heterologous polypeptide or amino acid sequence. Example of such chimeric molecules comprise any of the herein described polypeptides fused to an epitope tag sequence or a Fc region of an immunoglobulin.

In another embodiment, the invention provides an antibody which specifically binds to any of the above or below described polypeptides. Optionally, the antibody is a monoclonal antibody, humanized antibody, antibody fragment or single-chain antibody.

In yet other embodiments, the invention provides oligonucleotide probes useful for isolating genomic and cDNA nucleotide sequences or as antisense probes, wherein those probes may be derived from any of the above or below described nucleotide sequences.

In other embodiments, the invention provides an isolated nucleic acid molecule comprising a nucleotide sequence that encodes a PRO polypeptide.

In one aspect, the isolated nucleic acid molecule comprises a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule encoding a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein, or (b) the complement of the DNA molecule of (a).

In other aspects, the isolated nucleic acid molecule comprises a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule comprising the coding sequence of a full-length PRO polypeptide cDNA as disclosed herein, the coding sequence of a PRO polypeptide lacking the signal peptide as disclosed herein, the coding sequence of an extracellular domain of a transmembrane PRO polypeptide, with or without the signal peptide, as disclosed herein or the coding sequence of any other specifically defined fragment of the full-length amino acid sequence as disclosed herein, or (b) the complement of the DNA molecule of (a).

In a further aspect, the invention concerns an isolated nucleic acid molecule comprising a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule that encodes the same mature polypeptide encoded by any of the human protein cDNAs as disclosed herein, or (b) the complement of the DNA molecule of (a).

Another aspect the invention provides an isolated nucleic acid molecule comprising a nucleotide sequence encoding a PRO polypeptide which is either transmembrane domain-deleted or transmembrane domain-inactivated, or is complementary to such encoding nucleotide sequence, wherein the transmembrane domain(s) of such polypeptide are disclosed herein. Therefore, soluble extracellular domains of the herein described PRO polypeptides are contemplated.

Another embodiment is directed to fragments of a PRO polypeptide coding sequence, or the complement thereof, that may find use as, for example, hybridization probes, for encoding fragments of a PRO polypeptide that may optionally encode a polypeptide comprising a binding site for an anti-PRO antibody or as antisense oligonucleotide probes. Such nucleic acid fragments are usually at least about 20 nucleotides in length, alternatively at least about 30 nucleotides in length, alternatively at least about 40 nucleotides in length, alternatively at least about 50 nucleotides in length, alternatively at least about 60 nucleotides in length, alternatively at least about 70 nucleotides in length, alternatively at least about 80 nucleotides in length, alternatively at least about 90 nucleotides in length, alternatively at least about 100 nucleotides in length, alternatively at least about 110 nucleotides in length, alternatively at least about 120 nucleotides in length, alternatively at least about 130 nucleotides in length, alternatively at least about 140 nucleotides in length, alternatively at least about 150 nucleotides in length, alternatively at least about 160 nucleotides in length, alternatively at least about 170 nucleotides in length, alternatively at least about 180 nucleotides in length, alternatively at least about 190 nucleotides in length, alternatively at least about 200 nucleotides in length, alternatively at least about 250 nucleotides in length, alternatively at least about 300 nucleotides in length, alternatively at least about 350 nucleotides in length, alternatively at least about 400 nucleotides in length, alternatively at least about 450 nucleotides in length, alternatively at least about 500 nucleotides in length, alternatively at least about 600 nucleotides in length, alternatively at least about 700 nucleotides in length, alternatively at least about 800 nucleotides in length, alternatively at least about 900 nucleotides in length and alternatively at least about 1000 nucleotides in length, wherein in this context the term "about" means the referenced nucleotide sequence length plus or minus 10% of that referenced length. It is noted that novel fragments of a PRO polypeptide-encoding nucleotide sequence may be determined in a routine manner by aligning the PRO polypeptide-encoding nucleotide sequence with other known nucleotide sequences using any of a number of well known sequence alignment programs and determining which PRO polypeptide-encoding nucleotide sequence fragment(s) are novel. All of such PRO polypeptide-encoding nucleotide sequences are contemplated herein. Also contemplated are the PRO polypeptide fragments encoded by these nucleotide molecule fragments, preferably those PRO polypeptide fragments that comprise a binding site for an anti-PRO antibody.

In another embodiment, the invention provides isolated PRO polypeptide encoded by any of the isolated nucleic acid sequences herein above identified.

In a certain aspect, the invention concerns an isolated PRO polypeptide, comprising an amino acid sequence having at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a further aspect, the invention concerns an isolated PRO polypeptide comprising an amino acid sequence having at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to an amino acid sequence encoded by any of the human protein cDNAs as disclosed herein.

In a specific aspect, the invention provides an isolated PRO polypeptide without the N-terminal signal sequence and/or the initiating methionine and is encoded by a nucleotide sequence that encodes such an amino acid sequence as herein before described. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

Another aspect the invention provides an isolated PRO polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

In yet another embodiment, the invention concerns agonists and antagonists of a native PRO polypeptide as defined herein. In a particular embodiment, the agonist or antagonist is an anti-PRO antibody or a small molecule.

In a further embodiment, the invention concerns a method of identifying agonists or antagonists to a PRO polypeptide which comprise contacting the PRO polypeptide with a candidate molecule and monitoring a biological activity mediated by said PRO polypeptide. Preferably, the PRO polypeptide is a native PRO polypeptide.

In a still further embodiment, the invention concerns a composition of matter comprising a PRO polypeptide, or an agonist or antagonist of a PRO polypeptide as herein described, or an anti-PRO antibody, in combination with a carrier. Optionally, the carrier is a pharmaceutically acceptable carrier.

Another embodiment of the present invention is directed to the use of a PRO polypeptide, or an agonist or antagonist thereof as herein before described, or an anti-PRO antibody, for the preparation of a medicament useful in the treatment of a condition which is responsive to the PRO polypeptide, an agonist or antagonist thereof or an anti-PRO antibody.

BRIEF DESCRIPTION OF THE DRAWINGS

The FIGS. 1-596 (corresponding to SEQ ID NOs. 1-596, respectively) show the nucleic acids of the invention and their encoded PRO polypeptides. Also included, for convenience is a List of Figures attached hereto as Appendix A.

DETAILED DESCRIPTION OF THE PREFERRED EMBODIMENTS

I. Definitions

The terms "PRO polypeptide" and "PRO" as used herein and when immediately followed by a numerical designation refer to various polypeptides, wherein the complete designation (i.e., PRO/number) refers to specific polypeptide sequences as described herein. The terms "PRO/number polypeptide" and "PRO/number" wherein the term "number" is provided as an actual numerical designation as used herein encompass native sequence polypeptides and polypeptide variants (which are further defined herein). The PRO polypeptides described herein may be isolated from a variety of sources, such as from human tissue types or from another source, or prepared by recombinant or synthetic methods. The term "PRO polypeptide" refers to each individual PRO/number polypeptide disclosed herein. All disclosures in this specification which refer to the "PRO polypeptide" refer to each of the polypeptides individually as well as jointly. For example, descriptions of the preparation of, purification of, derivation of, formation of antibodies to or against, administration of, compositions containing, treatment of a disease with, etc., pertain to each polypeptide of the invention individually. The term "PRO polypeptide" also includes variants of the PRO/number polypeptides disclosed herein.

A "native sequence PRO polypeptide" comprises a polypeptide having the same amino acid sequence as the corresponding PRO polypeptide derived from nature. Such native sequence PRO polypeptides can be isolated from nature or can be produced by recombinant or synthetic means. The term "native sequence PRO polypeptide" specifically encompasses naturally-occurring truncated or secreted forms of the specific PRO polypeptide (e.g., an extracellular domain sequence), naturally-occurring variant forms (e.g., alternatively spliced forms) and naturally-occurring allelic variants of the polypeptide. In various embodiments of the invention, the native sequence PRO polypeptides disclosed herein are mature or full-length native sequence polypeptides comprising the full-length amino acids sequences shown in the accompanying figures. Start and stop codons are shown in bold font and underlined in the figures. However, while the PRO polypeptide disclosed in the accompanying figures are shown to begin with methionine residues designated herein as amino acid position 1 in the figures, it is conceivable and possible that other methionine residues located either upstream or downstream from the amino acid position 1 in the figures may be employed as the starting amino acid residue for the PRO polypeptides.

The PRO polypeptide "extracellular domain" or "ECD" refers to a form of the PRO polypeptide which is essentially free of the transmembrane and cytoplasmic domains. Ordinarily, a PRO polypeptide ECD will have less than 1% of such transmembrane and/or cytoplasmic domains and preferably, will have less than 0.5% of such domains. It will be understood that any transmembrane domains identified for the PRO polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a PRO polypeptide may contain from about 5 or fewer amino acids on either side of the transmembrane domain/extracellular domain boundary as identified in the Examples or specification and such polypeptides, with or without the associated signal peptide, and nucleic acid encoding them, are contemplated by the present invention.

The approximate location of the "signal peptides" of the various PRO polypeptides disclosed herein are shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.* 10:1-6 (1997) and von Heinje et al., *Nucl. Acids. Res.* 14:4683-4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"PRO polypeptide variant" means an active PRO polypeptide as defined above or below having at least about 80% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Such PRO polypeptide variants include, for instance, PRO polypeptides wherein one or more amino acid residues are added, or deleted, at the N- or C-terminus of the full-length native amino acid sequence. Ordinarily, a PRO polypeptide variant will have at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other specifically defined fragment of a full-length PRO polypeptide sequence as disclosed herein. Ordinarily, PRO variant polypeptides are at least about 10 amino acids in length, alternatively at least about 20 amino acids in length, alternatively at least about 30 amino acids in length, alternatively at least about 40 amino acids in length, alternatively at least about 50 amino acids in length, alternatively at least about 60 amino acids in length, alternatively at least about 70 amino acids in length, alternatively at least about 80 amino acids in length, alternatively at least about 90 amino acids in length, alternatively at least about 100 amino acids in length, alternatively at least about 150 amino acids in length, alternatively at least about 200 amino acids in length, alternatively at least about 300 amino acids in length, or more.

"Percent (%) amino acid sequence identity" with respect to the PRO polypeptide sequences identified herein is defined as the percentage of amino acid residues in a candidate sequence that are identical with the amino acid residues in the specific PRO polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated "Comparison Protein" to the amino acid sequence designated "PRO", wherein "PRO" represents the amino acid sequence of a hypothetical PRO polypeptide of interest, "Comparison Protein" represents the amino acid sequence of a polypeptide against which the "PRO" polypeptide of interest is being compared, and "X," "Y" and "Z" each represent different hypothetical amino acid residues.

Unless specifically stated otherwise, all % amino acid sequence identity values used herein are obtained as described in the immediately preceding paragraph using the ALIGN-2 computer program. However, % amino acid sequence identity values may also be obtained as described below by using the WU-BLAST-2 computer program (Altschul et al., *Methods in Enzymology* 266:460-480 (1996)). Most of the WU-BLAST-2 search parameters are set to the default values. Those not set to default values, i.e., the adjustable parameters, are set with the following values: overlap span=1, overlap fraction=0.125, word threshold (I)=11, and scoring matrix=BLOSUM62. When WU-BLAST-2 is employed, a % amino acid sequence identity value is determined by dividing (a) the number of matching identical amino acid residues between the amino acid sequence of the PRO polypeptide of interest having a sequence derived from the native PRO polypeptide and the comparison amino acid sequence of interest (i.e., the sequence against which the PRO polypeptide of interest is being compared which may be a PRO variant polypeptide) as determined by WU-BLAST-2 by (b) the total number of amino acid residues of the PRO polypeptide of interest For example, in the statement "a polypeptide comprising an the amino acid sequence A which has or having at least 80% amino acid sequence identity to the amino acid sequence B", the amino acid sequence A is the comparison amino acid sequence of interest and the amino acid sequence B is the amino acid sequence of the PRO polypeptide of interest.

Percent amino acid sequence identity may also be determined using the sequence comparison program NCBI-BLAST2 (Altschul et al., Nucleic Acids Res. 25:3389-3402 (1997)). The NCBI-BLAST2 sequence comparison program may be obtained from the National Institute of Health, Bethesda, Md. NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program NCBI-BLAST2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

"PRO variant polynucleotide" or "PRO variant nucleic acid sequence" means a nucleic acid molecule which encodes an active PRO polypeptide as defined below and which has at least about 80% nucleic acid sequence identity with a nucleotide acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Ordinarily, a PRO variant polynucleotide will have at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity with a nucleic acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal sequence, as disclosed herein or any other fragment of a full-length PRO polypeptide sequence as disclosed herein. Variants do not encompass the native nucleotide sequence.

Ordinarily, PRO variant polynucleotides are at least about 30 nucleotides in length, alternatively at least about 60 nucleotides in length, alternatively at least about 90 nucleotides in length, alternatively at least about 120 nucleotides in length, alternatively at least about 150 nucleotides in length, alternatively at least about 180 nucleotides in length, alternatively at least about 210 nucleotides in length, alternatively at least about 240 nucleotides in length, alternatively at least about 270 nucleotides in length, alternatively at least about 300 nucleotides in length, alternatively at least about 450 nucleotides in length, alternatively at least about 600 nucleotides in length, alternatively at least about 900 nucleotides in length, or more.

"Percent (%) nucleic acid sequence identity" with respect to PRO-encoding nucleic acid sequences identified herein is defined as the percentage of nucleotides in a candidate sequence that are identical with the nucleotides in the PRO nucleic acid sequence of interest, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "PRO-DNA", wherein "PRO-DNA" represents a hypothetical PRO-encoding nucleic acid sequence of interest, "Comparison DNA" represents the nucleotide sequence of a nucleic acid molecule against which the "PRO-DNA" nucleic acid molecule of interest is being compared, and "N", "L" and "V" each represent different hypothetical nucleotides.

Unless specifically stated otherwise, all % nucleic acid sequence identity values used herein are obtained as described in the immediately preceding paragraph using the ALIGN-2 computer program However, % nucleic acid sequence identity values may also be obtained as described below by using the WU-BLAST-2 computer program (Altschul et al., *Methods in Enzymology* 266:460-480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % nucleic acid sequence identity value is determined by dividing (a) the number of matching identical nucleotides between the nucleic acid sequence of the PRO polypeptide-encoding nucleic acid molecule of interest having a sequence derived from the native sequence PRO polypeptide-encoding nucleic acid and the comparison nucleic acid molecule of interest (i.e., the sequence against which the PRO polypeptide-encoding nucleic acid molecule of interest is being compared which may be a variant PRO polynucleotide) as determined by WU-BLAST-2 by (b) the total number of nucleotides of the PRO polypeptide-encoding nucleic acid molecule of interest. For example, in the statement "an isolated nucleic acid molecule comprising a nucleic acid sequence A which has or having at least 80% nucleic acid sequence identity to the nucleic acid sequence B", the nucleic acid sequence A is the comparison nucleic acid molecule of interest and the nucleic acid sequence B is the nucleic acid sequence of the PRO polypeptide-encoding nucleic acid molecule of interest.

Percent nucleic acid sequence identity may also be determined using the sequence comparison program NCBI-BLAST2 (Altschul et al., Nucleic Acids Res. 25:3389-3402 (1997)). The NCBI-BLAST2 sequence comparison program may be obtained from the National Institute of Health, Bethesda, Md. NCBI-BLAST2 uses several search parameters, wherein all of those search parameters are set to default values including, for example, unmask=yes, strand=all, expected occurrences=10, minimum low complexity length=15/5 , multi-pass e-value=0.01, constant for multi-pass=25, dropoff for final gapped alignment=25 and scoring matrix=BLOSUM62.

In situations where NCBI-BLAST2 is employed for sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program NCBI-BLAST2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C.

In other embodiments, PRO variant polynucleotides are nucleic acid molecules that encode an active PRO polypeptide and which are capable of hybridizing, preferably under stringent hybridization and wash conditions, to nucleotide sequences encoding a full-length PRO polypeptide as disclosed herein. PRO variant polypeptides may be those that are encoded by a PRO variant polynucleotide.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the PRO polypeptide natural environment will not be present Ordinarily, however, isolated polypeptide will be prepared by at least one purification step.

An "isolated" PRO polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "antibody" is used in the broadest sense and specifically covers, for example, single anti-PRO monoclonal antibodies (including agonist, antagonist, and neutralizing antibodies), anti-PRO antibody compositions with poly-epitopic specificity, single chain anti-PRO antibodies, and fragments of anti-PRO antibodies (see below). The term "monoclonal antibody" as used herein refers to an antibody obtained from a population of substantially homogeneous antibodies, i.e., the individual antibodies comprising the population are identical except for possible naturally-occurring mutations that may be present in minor amounts.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, may be identified by those that (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 µg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

The term "epitope tagged" when used herein refers to a chimeric polypeptide comprising a PRO polypeptide fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

As used herein, the term "immunoadhesin" designates antibody-like molecules which combine the binding specificity of a heterologous protein (an "adhesin") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG-4 subtypes, IgA (including IgA-1 and IgA-2), IgE, IgD or IgM.

"Active" or "activity" for the purposes herein refers to form(s) of a PRO polypeptide which retain a biological and/or an immunological activity of native or naturally-occurring PRO, wherein "biological" activity refers to a biological function (either inhibitory or stimulatory) caused by a native or naturally-occurring PRO other than the ability to induce the production of an antibody against an antigenic epitope possessed by a native or naturally-occurring PRO and an "immunological" activity refers to the ability to induce the production of an antibody against an antigenic epitope possessed by a native or naturally-occurring PRO.

The term "antagonist" is used in the broadest sense, and includes any molecule that partially or fully blocks, inhibits, or neutralizes a biological activity of a native PRO polypeptide disclosed herein. In a similar manner, the term "agonist" is used in the broadest sense and includes any molecule that mimics a biological activity of a native PRO polypeptide disclosed herein. Suitable agonist or antagonist molecules specifically include agonist or antagonist antibodies or antibody fragments, fragments or amino acid sequence variants of native PRO polypeptides, peptides, antisense oligonucleotides, small organic molecules, etc. Methods for identifying agonists or antagonists of a PRO polypeptide may comprise contacting a PRO polypeptide with a candidate agonist or antagonist molecule and measuring a detectable change in one or more biological activities normally associated with the PRO polypeptide.

"Treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of treatment refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

"Antibody fragments" comprise a portion of an intact antibody, preferably the antigen binding or variable region of the intact antibody. Examples of antibody fragments include Fab, Fab', F(ab')$_2$, and Fv fragments; diabodies; linear antibodies (Zapata et al., *Protein Eng.* 8(10): 1057-1062 [1995]); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen-combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA*, 90:6444-6448 (1993).

An "isolated" antibody is one which has been identified and separated and/or recovered from a component of its natural environment Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

An antibody that "specifically binds to" or is "specific for" a particular polypeptide or an epitope on a particular polypeptide is one that binds to that particular polypeptide or epitope on a particular polypeptide without substantially binding to any other polypeptide or polypeptide epitope.

The word "label" when used herein refers to a detectable compound or composition which is conjugated directly or indirectly to the antibody so as to generate a "labeled" antibody. The label may be detectable by itself (e.g. radioisotope labels or fluorescent labels) or, in the case of an enzymatic label, may catalyze chemical alteration of a substrate compound or composition which is detectable.

By "solid phase" is meant a non-aqueous matrix to which the antibody of the present invention can adhere. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant which is useful for delivery of a drug (such as a PRO polypeptide or antibody thereto) to a mammal. The components of the liposome are commonly arranged in a bilayer formation, similar to the lipid arrangement of biological membranes.

A "small molecule" is defined herein to have a molecular weight below about 500 Daltons.

The term "immune related disease" means a disease in which a component of the immune system of a mammal causes, mediates or otherwise contributes to a morbidity in the mammal. Also included are diseases in which stimulation or intervention of the immune response has an ameliorative effect on progression of the disease. Included within this term are immune-mediated inflammatory diseases, non-immune-mediated inflammatory diseases, infectious diseases, immunodeficiency diseases, neoplasia, etc.

The term "T cell mediated disease" means a disease in which T cells directly or indirectly mediate or otherwise contribute to a morbidity in a mammal. The T cell mediated disease may be associated with cell mediated effects, lymphokine mediated effects, etc., and even effects associated with B cells if the B cells are stimulated, for example, by the lymphokines secreted by T cells.

Examples of immune-related and inflammatory diseases, include: systemic lupus erythematosis, (SLE), rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune or immune-mediated skin diseases including bullous skin diseases, erythema multiforme and contact dermatitis, psoriasis, lymphadenopathy, splenomegaly and leukopenia.

The term "effective amount" is a concentration or amount of a PRO polypeptide and/or agonist/antagonist which results in achieving a particular stated purpose. An "effective amount" of a PRO polypeptide or agonist or antagonist thereof may be determined empirically. Furthermore, a "therapeutically effective amount" is a concentration or amount of a PRO polypeptide and/or agonist/antagonist which is effective for achieving a stated therapeutic effect. This amount may also be determined empirically.

The term "cytotoxic agent" as used herein refers to a substance that inhibits or prevents the function of cells and/or causes destruction of cells. The term is intended to include radioactive isotopes (e.g. $I^{131}$, $I^{125}$, $Y^{90}$ and $Re^{186}$), chemotherapeutic agents, and toxins such as enzymatically active toxins of bacterial, fungal, plant or animal origin, or fragments thereof.

A "chemotherapeutic agent" is a chemical compound useful in the treatment of cancer. Examples of chemotherapeutic agents include adriamycin, doxorubicin, epirubicin, 5-fluorouracil, cytosine arabinoside ("Ara-C"), cyclophosphamide, thiotepa, busulfan, cytoxin, taxoids, e.g., paclitaxel (Taxol, Bristol-Myers Squibb Oncology, Princeton, N.J.), and doxetaxel (Taxotere, Rhône-Poulenc Rorer, Antony, France), toxotere, methotrexate, cisplatin, melphalan, vinblastine, bleomycin, etoposide, ifosfamide, mitomycin C, mitoxantrone, vincristine, vinorelbine, carboplatin, teniposide, daunomycin, caminomycin, aminopterin, dactinomycin, mitomycins, esperamicins (see U.S. Pat. No. 4,675,187), melphalan and other related nitrogen mustards. Also included in this definition are hormonal agents that act to regulate or inhibit hormone action on tumors such as tamoxifen and onapristone.

A "growth inhibitory agent" when used herein refers to a compound or composition which inhibits growth of a cell, especially cancer cell overexpressing any of the genes identified herein, either in vitro or in vivo. Thus, the growth inhibitory agent is one which significantly reduces the percentage of cells overexpressing such genes in S phase. Examples of growth inhibitory agents include agents that block cell cycle progression (at a place other than S phase), such as agents that induce G1 arrest and M-phase arrest Classical M-phase blockers include the vincas (vincristine and vinblastine), taxol, and top II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in *The Molecular Basis of Cancer*, Mendelsohn and Israel, eds., Chapter 1, entitled "Cell cycle regulation, oncogens, and antineoplastic drugs" by Murakami et al. (WB Saunders: Philadelphia, 1995), especially p. 13.

The term "cytokine" is a generic term for proteins released by one cell population which act on another cell as intercellular mediators. Examples of such cytokines are lymphokines, monokines, and traditional polypeptide hormones. Included among the cytokines are growth hormone such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor, prolactin; placental lactogen; tumor necrosis factor-$\alpha$ and -$\beta$; mullerian-inhibiting substance; mouse gonadotropin-associated peptide; inhibin; activin; vascular endothelial growth factor, integrin; thrombopoietin (TPO); nerve growth factors such as NGF-$\beta$; platelet-growth factor; transforming growth factors (TGFs) such as TGF-$\alpha$ and TGF-$\beta$; insulin-like growth factor-I and -II; erythropoietin (EPO); osteoinductive factors; interferons such as interferon-$\alpha$, -$\beta$, and -$\gamma$; colony stimulating factors (CSFs) such as macrophage-CSF (M-CSF); granulocyte-macrophage-CSF (GM-CSF); and granulocyte-CSF (G-CSF); interleukins (ILs) such as IL-1, IL-1$\alpha$, IL-2, IL-3, IL-4, IL-5, IL-6, IL-7, IL-8, IL-9, IL-11, IL-12; a tumor necrosis factor such as TNF-$\alpha$ or TNF-$\beta$; and other polypeptide factors including LIF and kit ligand (KL). As used herein, the term cytokine includes proteins from natural sources or from recombinant cell culture and biologically active equivalents of the native sequence cytokines.

As used herein, the term "immunoadhesin" designates antibody-like molecules which combine the binding specificity of a heterologous protein (an "adhesin") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG-4 subtypes, IgA (including IgA-1 and IgA-2), IgE, IgD or IgM.

As used herein, the term "inflammatory cells" designates cells that enhance the inflammatory response such as mononuclear cells, eosinophils, macrophages, and polymorphonuclear neutrophils (PMN).

Table 1

```
/*
 *
 * C-C increased from 12 to 15
 * Z is average of EQ
 * B is average of ND
 * match with stop is _M; stop-stop = 0; J (joker) match = 0
 */
define    _M    -8    /* value of a match with a stop */ int    _day[26][26] = {
/*       A  B  C  D  E  F  G  H  I  J  K  L  M  N  O  P  Q  R  S  T  U  V  W  X  Y  Z */
/* A */  { 2, 0,-2, 0, 0,-4, 1,-1,-1, 0,-1,-2,-1, 0,_M, 1, 0,-2, 1, 1, 0, 0,-6, 0,-3, 0},
/* B */  { 0, 3,-4, 3, 2,-5, 0, 1,-2, 0, 0,-3,-2, 2,_M,-1, 1, 0, 0, 0, 0,-2,-5, 0,-3, 1},
/* C */  {-2,-4,15,-5,-5,-4,-3,-3,-2, 0,-5,-6,-5,-4,_M,-3,-5,-4, 0,-2, 0,-2,-8, 0, 0,-5},
/* D */  { 0, 3,-5, 4, 3,-6, 1, 1,-2, 0, 0,-4,-3, 2,_M,-1, 2,-1, 0, 0, 0,-2,-7, 0,-4, 2},
/* E */  { 0, 2,-5, 3, 4,-5, 0, 1,-2, 0, 0,-3,-2, 1,_M,-1, 2,-1, 0, 0, 0,-2,-7, 0,-4, 3},
/* F */  {-4,-5,-4,-6,-5, 9,-5,-2, 1, 0,-5, 2, 0,-4,_M,-5,-5,-4,-3,-3, 0,-1, 0, 0, 7,-5},
/* G */  { 1, 0,-3, 1, 0,-5, 5,-2,-3, 0,-2,-4,-3, 0,_M,-1,-1,-3, 1, 0, 0,-1,-7, 0,-5, 0},
/* H */  {-1, 1,-3, 1, 1,-2,-2, 6,-2, 0, 0,-2,-2, 2,_M, 0, 3, 2,-1,-1, 0,-2,-3, 0, 0, 2},
/* I */  {-1,-2,-2,-2,-2, 1,-3,-2, 5, 0,-2, 2, 2,-2,_M,-2,-2,-2,-1, 0, 0, 4,-5, 0,-1,-2},
/* J */  { 0, 0, 0, 0, 0, 0, 0, 0, 0, 0, 0, 0, 0, 0,_M, 0, 0, 0, 0, 0, 0, 0, 0, 0, 0, 0},
/* K */  {-1, 0,-5, 0, 0,-5,-2, 0,-2, 0, 5,-3, 0, 1,_M,-1, 1, 3, 0, 0, 0,-2,-3, 0,-4, 0},
/* L */  {-2,-3,-6,-4,-3, 2,-4,-2, 2, 0,-3, 6, 4,-3,_M,-3,-2,-3,-3,-1, 0, 2,-2, 0,-1,-2},
/* M */  {-1,-2,-5,-3,-2, 0,-3,-2, 2, 0, 0, 4, 6,-2,_M,-2,-1, 0,-2,-1, 0, 2,-4, 0,-2,-1},
/* N */  { 0, 2,-4, 2, 1,-4, 0, 2,-2, 0, 1,-3,-2, 2,_M,-1, 1, 0, 1, 0, 0,-2,-4, 0,-2, 1},
/* O */  {_M,_M,_M,_M,_M,_M,_M,_M,_M,_M,_M,_M,_M,_M,
0,_M,_M,_M,_M,_M,_M,_M,_M,_M,_M,_M},
/* P */  { 1,-1,-3,-1,-1,-5,-1, 0,-2, 0,-1,-3,-2,-1,_M, 6, 0, 0, 1, 0, 0,-1,-6, 0,-5, 0},
/* Q */  { 0, 1,-5, 2, 2,-5,-1, 3,-2, 0, 1,-2,-1, 1,_M, 0, 4, 1,-1,-1, 0,-2,-5, 0,-4, 3},
/* R */  {-2, 0,-4,-1,-1,-4,-3, 2,-2, 0, 3,-3, 0, 0,_M, 0, 1, 6, 0,-1, 0,-2, 2, 0,-4, 0},
/* S */  { 1, 0, 0, 0, 0,-3, 1,-1,-1, 0, 0,-3,-2, 1,_M, 1,-1, 0, 2, 1, 0,-1,-2, 0,-3, 0},
/* T */  { 1, 0,-2, 0, 0,-3, 0,-1, 0, 0, 0,-1,-1, 0,_M, 0,-1,-1, 1, 3, 0, 0,-5, 0,-3, 0},
/* U */  { 0, 0, 0, 0, 0, 0, 0, 0, 0, 0, 0, 0, 0, 0,_M, 0, 0, 0, 0, 0, 0, 0, 0, 0, 0, 0},
/* V */  { 0,-2,-2,-2,-2,-1,-1,-2, 4, 0,-2, 2, 2,-2,_M,-1,-2,-2,-1, 0, 0, 4,-6, 0,-2,-2},
/* W */  {-6,-5,-8,-7,-7, 0,-7,-3,-5, 0,-3,-2,-4,-4,_M,-6,-5, 2,-2,-5, 0,-6,17, 0, 0,-6},
/* X */  { 0, 0, 0, 0, 0, 0, 0, 0, 0, 0, 0, 0, 0, 0,_M, 0, 0, 0, 0, 0, 0, 0, 0, 0, 0, 0},
/* Y */  {-3,-3, 0,-4,-4, 7,-5, 0,-1, 0,-4,-1,-2,-2,_M,-5,-4,-4,-3,-3, 0,-2, 0, 0,10,-4},
/* Z */  { 0, 1,-5, 2, 3,-5, 0, 2,-2, 0, 0,-2,-1, 1,_M, 0, 3, 0, 0, 0, 0,-2,-6, 0,-4, 4}
};
```

Table 1 (cont')

```
/*
*/
#include <stdio.h>
include <ctype.h> define  MAXJMP    16      /* max jumps in a diag */
define  MAXGAP    24      /* don't continue to penalize gaps larger than this */
#define  JMPS      1024    /* max jmps in an path */
define  MX        4       /* save if there's at least MX-1 bases since last jmp */ define  DMAT      3       /* value of matching bases */
define  DMIS      0       /* penalty for mismatched bases */
#define  DINS0     8       /* penalty for a gap */
#define  DINS1     1       /* penalty per base */
#define  PINS0     8       /* penalty for a gap */
define  PINS1     4       /* penalty per residue */ struct jmp {
        short           n[MAXJMP];      /* size of jmp (neg for dely) */
        unsigned short  x[MAXJMP];      /* base no. of jmp in seq x */
};                                      /* limits seq to 2^16 -1 */ struct diag {
        int        score;     /* score at last jmp */
        long       offset;    /* offset of prev block */
        short      ijmp;      /* current jmp index */
        struct jmp jp;        /* list of jmps */
};

struct path {
        int    spc;           /* number of leading spaces */
        short  n[JMPS];       /* size of jmp (gap) */
        int    x[JMPS];       /* loc of jmp (last elem before gap) */
};

char         *ofile;          /* output file name */
char         *namex[2];       /* seq names: getseqs() */
char         *prog;           /* prog name for err msgs */
char         *seqx[2];        /* seqs: getseqs() */
int          dmax;            /* best diag: nw() */
int          dmax0;           /* final diag */
int          dna;             /* set if dna: main() */
int          endgaps;         /* set if penalizing end gaps */
int          gapx, gapy;      /* total gaps in seqs */
int          len0, len1;      /* seq lens */
int          ngapx, ngapy;    /* total size of gaps */
int          smax;            /* max score: nw() */
int          *xbm;            /* bitmap for matching */
long         offset;          /* current offset in jmp file */
struct diag  *dx;             /* holds diagonals */
struct path  pp[2];           /* holds path for seqs */ char         *calloc(), *malloc(), *index(), *strcpy();
char         *getseq(), *g_calloc();
```

Table 1 (cont')

```
/* Needleman-Wunsch alignment program
 *
 * usage: progs file1 file2
 *   where file1 and file2 are two dna or two protein sequences.
 *   The sequences can be in upper- or lower-case an may contain ambiguity
 *   Any lines beginning with ';', '>' or '<' are ignored
 *   Max file length is 65535 (limited by unsigned short x in the jmp struct)
 *   A sequence with 1/3 or more of its elements ACGTU is assumed to be DNA
 *   Output is in the file "align.out"
 *
 * The program may create a tmp file in /tmp to hold info about traceback.
 * Original version developed under BSD 4.3 on a vax 8650
 */
include "nw.h"
#include "day.h"

static  _dbval[26] = {
        1,14,2,13,0,0,4,11,0,0,12,0,3,15,0,0,0,5,6,8,8,7,9,0,10,0
};

static  _pbval[26] = {
        1, 2|(1<<('D'-'A'))|(1<<('N'-'A')), 4, 8, 16, 32, 64,
        128, 256, 0xFFFFFFFF, 1<<10, 1<<11, 1<<12, 1<<13, 1<<14,
        1<<15, 1<<16, 1<<17, 1<<18, 1<<19, 1<<20, 1<<21, 1<<22,
        1<<23, 1<<24, 1<<25|(1<<('E'-'A'))|(1<<('Q'-'A'))
};

main(ac, av)
``` main

```
        int     ac;
        char    *av[ ];
{
        prog = av[0];
        if (ac != 3) {
                fprintf(stderr,"usage: %s file1 file2\n", prog);
                fprintf(stderr,"where file1 and file2 are two dna or two protein sequences.\n");
                fprintf(stderr,"The sequences can be in upper- or lower-case\n");
                fprintf(stderr,"Any lines beginning with ';' or '<' are ignored\n");
                fprintf(stderr,"Output is in the file \"align.out\"\n");
                exit(1);
        }
        namex[0] = av[1];
        namex[1] = av[2];
        seqx[0] = getseq(namex[0], &len0);
        seqx[1] = getseq(namex[1], &len1);
        xbm = (dna)? _dbval : _pbval;

endgaps = 0;              /* 1 to penalize endgaps */
        ofile = "align.out";      /* output file */ nw();                     /* fill in the matrix, get the possible jmps */
        readjmps();               /* get the actual jmps */
        print();                  /* print stats, alignment */ cleanup(0);               /* unlink any tmp files */
}
```

Table 1 (cont')

```
/* do the alignment, return best score: main()
 * dna: values in Fitch and Smith, PNAS, 80, 1382-1386, 1983
 * pro: PAM 250 values
 * When scores are equal, we prefer mismatches to any gap, prefer
 * a new gap to extending an ongoing gap, and prefer a gap in seqx
 * to a gap in seq y.
 */
nw()
         nw
{
         char       *px, *py;         /* seqs and ptrs */
         int        *ndely, *dely;    /* keep track of dely */
         int        ndelx, delx;      /* keep track of delx */
         int        *tmp;             /* for swapping row0, row1 */
         int        mis;              /* score for each type */
         int        ins0, ins1;       /* insertion penalties */
         register   id;               /* diagonal index */
         register   ij;               /* jmp index */
         register   *col0, *col1;     /* score for curr, last row */
         register   xx, yy;           /* index into seqs */ dx = (struct diag *)g_calloc("to get diags", len0+len1+1, sizeof(struct diag));

ndely = (int *)g_calloc("to get ndely", len1+1, sizeof(int));
         dely  = (int *)g_calloc("to get dely", len1+1, sizeof(int));
         col0  = (int *)g_calloc("to get col0", len1+1, sizeof(int));
         col1  = (int *)g_calloc("to get col1", len1+1, sizeof(int));
         ins0  = (dna)? DINS0 : PINS0;
         ins1  = (dna)? DINS1 : PINS1;

smax = -10000;
         if (endgaps) {
                   for (col0[0] = dely[0] = -ins0, yy = 1; yy <= len1; yy++) {
                            col0[yy] = dely[yy] = col0[yy-1] - ins1;
                            ndely[yy] = yy;
                   }
                   col0[0] = 0;          /* Waterman Bull Math Biol 84 */
         }
         else
                   for (yy = 1; yy <= len1; yy++)
                            dely[yy] = -ins0;

/* fill in match matrix
          */
         for (px = seqx[0], xx = 1; xx <= len0; px++, xx++) {
                   /* initialize first entry in col
                    */
                   if (endgaps) {
                            if (xx == 1)
                                     col1[0] = delx = -(ins0+ins1);
                            else
                                     col1[0] = delx = col0[0] - ins1;
                            ndelx = xx;
                   }
                   else {
                            col1[0] = 0;
                            delx = -ins0;
                            ndelx = 0;
                   }
```

Table 1 (cont')

...nw

```
for (py = seqx[1], yy = 1; yy <= len1; py++, yy++) {
        mis = col0[yy-1];
        if (dna)
                mis += = (xbm[*px-'A']&xbm[*py-'A'])? DMAT : DMIS;
        else
                mis += = _day[*px-'A'][*py-'A'];

/* update penalty for del in x seq;
         * favor new del over ongong del
         * ignore MAXGAP if weighting endgaps
         */
        if (endgaps || ndely[yy] < MAXGAP) {
                if (col0[yy] - ins0 >= dely[yy]) {
                        dely[yy] = col0[yy] - (ins0+ins1);
                        ndely[yy] = 1;
                } else {
                        dely[yy] -= ins1;
                        ndely[yy]++;
                }
        } else {
                if (col0[yy] - (ins0+ins1) >= dely[yy]) {
                        dely[yy] = col0[yy] - (ins0+ins1);
                        ndely[yy] = 1;
                } else
                        ndely[yy]++;
        }

/* update penalty for del in y seq;
         * favor new del over ongong del
         */
        if (endgaps || ndelx < MAXGAP) {
                if (col1[yy-1] - ins0 >= delx) {
                        delx = col1[yy-1] - (ins0+ins1);
                        ndelx = 1;
                } else {
                        delx -= ins1;
                        ndelx++;
                }
        } else {
                if (col1[yy-1] - (ins0+ins1) >= delx) {
                        delx = col1[yy-1] - (ins0+ins1);
                        ndelx = 1;
                } else
                        ndelx++;
        }

/* pick the maximum score; we're favoring
         * mis over any del and delx over dely
         */
```

Table 1 (cont')

...nw

```
                                id = xx - yy + len1 - 1;
                                if (mis >= delx && mis >= dely[yy])
                                        col1[yy] = mis;
                                else if (delx >= dely[yy]) {
                                        col1[yy] = delx;
                                        ij = dx[id].ijmp;
                                        if (dx[id].jp.n[0] && (!dna || (ndelx >= MAXJMP
                                                && xx > dx[id].jp.x[ij]+MX) || mis > dx[id].score+DINS0)) {
                                                        dx[id].ijmp++;
                                                        if (++ij >= MAXJMP) {
                                                                writejmps(id);
                                                                ij = dx[id].ijmp = 0;
                                                                dx[id].offset = offset;
                                                                offset += sizeof(struct jmp) + sizeof(offset);
                                                        }
                                        }
                                        dx[id].jp.n[ij] = ndelx;
                                        dx[id].jp.x[ij] = xx;
                                        dx[id].score = delx;
                                }
                                else {
                                        col1[yy] = dely[yy];
                                        ij = dx[id].ijmp;
                if (dx[id].jp.n[0] && (!dna || (ndely[yy] >= MAXJMP
                                                && xx > dx[id].jp.x[ij]+MX) || mis > dx[id].score+DINS0)) {
                                                        dx[id].ijmp++;
                                                        if (++ij >= MAXJMP) {
                                                                writejmps(id);
                                                                ij = dx[id].ijmp = 0;
                                                                dx[id].offset = offset;
                                                                offset += sizeof(struct jmp) + sizeof(offset);
                                                        }
                                        }
                                        dx[id].jp.n[ij] = -ndely[yy];
                                        dx[id].jp.x[ij] = xx;
                                        dx[id].score = dely[yy];
                                }
                                if (xx == len0 && yy < len1) {
                                        /* last col
                                        */
                                        if (endgaps)
                                                col1[yy] -= ins0+ins1*(len1-yy);
                                        if (col1[yy] > smax) {
                                                smax = col1[yy];
                                                dmax = id;
                                        }
                                }
                        }
                        if (endgaps && xx < len0)
                                col1[yy-1] -= ins0+ins1*(len0-xx);
                        if (col1[yy-1] > smax) {
                                smax = col1[yy-1];
                                dmax = id;
                        }
                        tmp = col0; col0 = col1; col1 = tmp;
                }
                (void) free((char *)ndely);
                (void) free((char *)dely);
                (void) free((char *)col0);
                (void) free((char *)col1);                              }
```

Table 1 (cont')

```
/*
 *
 * print() -- only routine visible outside this module
 *
 * static:
 * getmat() -- trace back best path, count matches: print()
 * pr_align() -- print alignment of described in array p[ ]: print()
 * dumpblock() -- dump a block of lines with numbers, stars: pr_align()
 * nums() -- put out a number line: dumpblock()
 * putline() -- put out a line (name, [num], seq, [num]): dumpblock()
 * stars() - -put a line of stars: dumpblock()
 * stripname() -- strip any path and prefix from a seqname
 */ include "nw.h"

define SPC     3
#define P_LINE  256     /* maximum output line */
define P_SPC   3       /* space between name or num and seq */ extern   _day[26][26];
int      olen;          /* set output line length */
FILE     *fx;           /* output file */ print()
{
        int     lx, ly, firstgap, lastgap;      /* overlap */ if ((fx = fopen(ofile, "w")) == 0) {
                fprintf(stderr,"%s: can't write %s\n", prog, ofile);
                cleanup(1);
        }
        fprintf(fx, "<first sequence: %s (length = %d)\n", namex[0], len0);
        fprintf(fx, "<second sequence: %s (length = %d)\n", namex[1], len1);
        olen = 60;
        lx = len0;
        ly = len1;
        firstgap = lastgap = 0;
        if (dmax < len1 - 1) {          /* leading gap in x */
                pp[0].spc = firstgap = len1 - dmax - 1;
                ly -= pp[0].spc;
        }
        else if (dmax > len1 - 1) {     /* leading gap in y */
                pp[1].spc = firstgap = dmax - (len1 - 1);
                lx -= pp[1].spc;
        }
        if (dmax0 < len0 - 1) {         /* trailing gap in x */
                lastgap = len0 - dmax0 -1;
                lx -= lastgap;
        }
        else if (dmax0 > len0 - 1) {    /* trailing gap in y */
                lastgap = dmax0 - (len0 - 1);
                ly -= lastgap;
        }
        getmat(lx, ly, firstgap, lastgap);
        pr_align();
}
```

Table 1 (cont')

```
/*
 * trace back the best path, count matches
 */
static
getmat(lx, ly, firstgap, lastgap)
        int     lx, ly;                 /* "core" (minus endgaps) */
        int     firstgap, lastgap;      /* leading trailing overlap */
{
        int             nm, i0, i1, siz0, siz1;
        char            outx[32];
        double          pct;
        register        n0, n1;
        register char   *p0, *p1;

/* get total matches, score
         */
        i0 = i1 = siz0 = siz1 = 0;
        p0 = seqx[0] + pp[1].spc;
        p1 = seqx[1] + pp[0].spc;
        n0 = pp[1].spc + 1;
        n1 = pp[0].spc + 1;

nm = 0;
        while ( *p0 && *p1 ) {
                if (siz0) {
                        p1++;
                        n1++;
                        siz0--;
                }
                else if (siz1) {
                        p0++;
                        n0++;
                        siz1--;
                }
                else {
                        if (xbm[*p0-'A']&xbm[*p1-'A'])
                                nm++;
                        if (n0++ == pp[0].x[i0])
                                siz0 = pp[0].n[i0++];
                        if (n1++ == pp[1].x[i1])
                                siz1 = pp[1].n[i1++];
                        p0++;
                        p1++;
                }
        }

/* pct homology:
         * if penalizing endgaps, base is the shorter seq
         * else, knock off overhangs and take shorter core
         */
        if (endgaps)
                lx = (len0 < len1)? len0 : len1;
        else
                lx = (lx < ly)? lx : ly;
        pct = 100.*(double)nm/(double)lx;
        fprintf(fx, "\n");
        fprintf(fx, " <%d match%s in an overlap of %d: %.2f percent similarity\n",
                nm, (nm == 1)? "" : "es", lx, pct);
``` getmat

Table 1 (cont')

```
          fprintf(fx, "<gaps in first sequence: %d", gapx);
```
...getmat
```
          if (gapx) {
                    (void) sprintf(outx, " (%d %s%s)",
                              ngapx, (dna)? "base":"residue", (ngapx == 1)? "":"s");
                    fprintf(fx,"%s", outx);

fprintf(fx, ", gaps in second sequence: %d", gapy);
          if (gapy) {
                    (void) sprintf(outx, " (%d %s%s)",
                              ngapy, (dna)? "base":"residue", (ngapy == 1)? "":"s");
                    fprintf(fx,"%s", outx);
          }
          if (dna)
                    fprintf(fx,
                     "\n<score: %d (match = %d, mismatch = %d, gap penalty = %d + %d per base)\n",
                     smax, DMAT, DMIS, DINS0, DINS1);
          else
                    fprintf(fx,
                     "\n<score: %d (Dayhoff PAM 250 matrix, gap penalty = %d + %d per residue)\n",
                     smax, PINS0, PINS1);
          if (endgaps)
                    fprintf(fx,
                     "<endgaps penalized. left endgap: %d %s%s, right endgap: %d %s%s\n",
                     firstgap, (dna)? "base" : "residue", (firstgap == 1)? "" : "s",
                     lastgap, (dna)? "base" : "residue", (lastgap == 1)? "" : "s");
          else
                    fprintf(fx, "<endgaps not penalized\n");
}
static         nm;              /* matches in core -- for checking */
static         lmax;            /* lengths of stripped file names */
static         ij[2];           /* jmp index for a path */
static         nc[2];           /* number at start of current line */
static         ni[2];           /* current elem number -- for gapping */
static         siz[2];
static char    *ps[2];          /* ptr to current element */
static char    *po[2];          /* ptr to next output char slot */
static char    out[2][P_LINE];  /* output line */
static char    star[P_LINE];    /* set by stars() */

/*
* print alignment of described in struct path pp[ ]
*/
static
pr_align()
```
pr_align
```
{
          int       nn;         /* char count */
          int       more;
          register  i;

for (i = 0, lmax = 0; i < 2; i++) {
                    nn = stripname(namex[i]);
                    if (nn > lmax)
                              lmax = nn;

nc[i] = 1;
                    ni[i] = 1;
                    siz[i] = ij[i] = 0;
                    ps[i] = seqx[i];
                    po[i] = out[i];                                    }
```

Table 1 (cont')

```
                   for (nn = nm = 0, more = 1; more; ) {
...pr_align
                           for (i = more = 0; i < 2; i++) {
                                   /*
                                    * do we have more of this sequence?
                                    */
                                   if (!*ps[i])
                                           continue;

more++;

if (pp[i].spc) {    /* leading space */
                                           *po[i]++ = ' ';
                                           pp[i].spc--;
                                   }
                                   else if (siz[i]) {    /* in a gap */
                                           *po[i]++ = '-';
                                           siz[i]--;
                                   }
                                   else {              /* we're putting a seq element
                                                        */
                                           *po[i] = *ps[i];
                                           if (islower(*ps[i]))
                                                   *ps[i] = toupper(*ps[i]);
                                           po[i]++;
                                           ps[i]++;

/*
                                            * are we at next gap for this seq?
                                            */
                                           if (ni[i] == pp[i].x[ij[i]]) {
                                                   /*
                                                    * we need to merge all gaps
                                                    * at this location
                                                    */
                                                   siz[i] = pp[i].n[ij[i]++];
                                                   while (ni[i] == pp[i].x[ij[i]])
                                                           siz[i] += pp[i].n[ij[i]++];
                                           }
                                           ni[i]++;
                                   }
                           }
                           if (++nn == olen || !more && nn) {
                                   dumpblock();
                                   for (i = 0; i < 2; i++)
                                           po[i] = out[i];
                                   nn = 0;
                           }
                   }
}

/*
 * dump a block of lines, including numbers, stars: pr_align()
 */
static
dumpblock()
dumpblock
{
           register i;
           for (i = 0; i < 2; i++)
                   *po[i]-- = '\0';
```

Table 1 (cont')

...dumpblock

```
                (void) putc('\n', fx);
                for (i = 0; i < 2; i++) {
                        if (*out[i] && (*out[i] != ' ' || *(po[i]) != ' ')) {
                                if (i == 0)
                                        nums(i);
                                if (i == 0 && *out[1])
                                        stars();
                                putline(i);
                                if (i == 0 && *out[1])
                                        fprintf(fx, star);
                                if (i == 1)
                                        nums(i);
                        }
                }
        }
}

/*
* put out a number line: dumpblock()
*/
static
nums(ix)                                                                    nums
        int     ix;     /* index in out[ ] holding seq line */
{
        char            nline[P_LINE];
        register        i, j;
        register char   *pn, *px, *py;

for (pn = nline, i = 0; i < lmax+P_SPC; i++, pn++)
                *pn = ' ';
        for (i = nc[ix], py = out[ix]; *py; py++, pn++) {
                if (*py == ' ' || *py == '-')
                        *pn = ' ';
                else {
                        if (i%10 == 0 || (i == 1 && nc[ix] != 1)) {
                                j = (i < 0)? -i : i;
                                for (px = pn; j; j /= 10, px--)
                                        *px = j%10 + '0';
                                if (i < 0)
                                        *px = '-';
                        }
                        else
                                *pn = ' ';
                        i++;
                }
        }
        *pn = '\0';
        nc[ix] = i;
        for (pn = nline; *pn; pn++)
                (void) putc(*pn, fx);
        (void) putc('\n', fx);
}

/*
* put out a line (name, [num], seq, [num]): dumpblock()
*/
static
putline(ix)                                                                 putline
        int     ix;                             {
```

Table 1 (cont')

...putline

```
    int             i;
    register char   *px;

for (px = namex[ix], i = 0; *px && *px != ':'; px++, i++)
            (void) putc(*px, fx);
    for (; i < lmax+P_SPC; i++)
            (void) putc(' ', fx);

/* these count from 1:
    * ni[ ] is current element (from 1)
    * nc[ ] is number at start of current line
    */
    for (px = out[ix]; *px; px++)
            (void) putc(*px&0x7F, fx);
    (void) putc('\n', fx);
}

/*
* put a line of stars (seqs always in out[0], out[1]): dumpblock()
*/
static
stars()
``` stars

```
{
    int             i;
    register char   *p0, *p1, cx, *px;

if ((!*out[0] || (*out[0] == ' ' && *(po[0]) == ' ') ||
        !*out[1] || (*out[1] == ' ' && *(po[1]) == ' ')))
            return;
    px = star;
    for (i = lmax+P_SPC; i; i--)
            *px++ = ' ';

for (p0 = out[0], p1 = out[1]; *p0 && *p1; p0++, p1++) {
        if (isalpha(*p0) && isalpha(*p1)) { if (xbm[*p0-'A']&xbm[*p1-'A']) {
                        cx = '*';
                        nm++;
                }
                else if (!dna && _day[*p0-'A'][*p1-'A'] > 0)
                        cx = '.';
                else
                        cx = ' ';
        }
        else
                cx = ' ';
        *px++ = cx;
    }
    *px++ = '\n';
    *px = '\0';
}
```

Table 1 (cont')

```
/*
 * strip path or prefix from pn, return len: pr_align()
 */
static
stripname(pn)
    stripname
    char    *pn;    /* file name (may be path) */
{
    register char   *px, *py;

py = 0;
    for (px = pn; *px; px++)
        if (*px == '/')
            py = px + 1;
    if (py)
        (void) strcpy(pn, py);
    return(strlen(pn));

}
```

Table 1 (cont')

```
/*
 * cleanup() -- cleanup any tmp file
 * getseq() -- read in seq, set dna, len, maxlen
 * g_calloc() -- calloc() with error checkin
 * readjmps() -- get the good jmps, from tmp file if necessary
 * writejmps() -- write a filled array of jmps to a tmp file: nw()
 */ include "nw.h"
include <sys/file.h> char    *jname = "/tmp/homgXXXXXX";     /* tmp file for jmps */
FILE    *fj;

int     cleanup();                      /* cleanup tmp file */
long    lseek();

/*
 * remove any tmp file if we blow
 */
cleanup(i)                                                                      cleanup
        int     i;
{
        if (fj)
                (void) unlink(jname);
        exit(i);
}

/*
 * read, return ptr to seq, set dna, len, maxlen
 * skip lines starting with ';', '<', or '>'
 * seq in upper or lower case
 */
char    *
getseq(file, len)                                                               getseq
        char    *file;          /* file name */
        int     *len;           /* seq len */
{
        char            line[1024], *pseq;
        register char   *px, *py;
        int             natgc, tlen;
        FILE            *fp;

if ((fp = fopen(file,"r")) == 0) {
                fprintf(stderr,"%s: can't read %s\n", prog, file);
                exit(1);
        }
        tlen = natgc = 0;
        while (fgets(line, 1024, fp)) {
                if (*line == ';' || *line == '<' || *line == '>')
                        continue;
                for (px = line; *px != '\n'; px++)
                        if (isupper(*px) || islower(*px))
                                tlen++;
        }
        if ((pseq = malloc((unsigned)(tlen+6))) == 0) {
                fprintf(stderr,"%s: malloc() failed to get %d bytes for %s\n", prog, tlen+6, file);
                exit(1);
        }
        pseq[0] = pseq[1] = pseq[2] = pseq[3] = '\0';
```

Table 1 (cont')

...getseq

```
        py = pseq + 4;
        *len = tlen;
        rewind(fp);

while (fgets(line, 1024, fp)) {
                if (*line == ';' || *line == '<' || *line == '>')
                        continue;
                for (px = line; *px != '\n'; px++) {
                        if (isupper(*px))
                                *py++ = *px;
                        else if (islower(*px))
                                *py++ = toupper(*px);
                        if (index("ATGCU",*(py-1)))
                                natgc++;
                }
        }
        *py++ = '\0';
        *py = '\0';
        (void) fclose(fp);
        dna = natgc > (tlen/3);
        return(pseq+4);
}
``` g_calloc

```
char    *
g_calloc(msg, nx, sz)
        char    *msg;           /* program, calling routine */
        int     nx, sz;         /* number and size of elements */
{
        char            *px, *calloc();

if ((px = calloc((unsigned)nx, (unsigned)sz)) == 0) {
                if (*msg) {
                        fprintf(stderr, "%s: g_calloc() failed %s (n=%d, sz=%d)\n", prog, msg, nx, sz);
                        exit(1);
                }
        }
        return(px);
}

/*
 * get final jmps from dx[ ] or tmp file, set pp[ ], reset dmax: main()
 */
readjmps()
``` readjmps

```
{
        int             fd = -1;
        int             siz, i0, i1;
        register i, j, xx;

if (fj) {
                (void) fclose(fj);
                if ((fd = open(jname, O_RDONLY, 0)) < 0) {
                        fprintf(stderr, "%s: can't open() %s\n", prog, jname);
                        cleanup(1);
                }
        }
        for (i = i0 = i1 = 0, dmax0 = dmax, xx = len0; ; i++) {
                while (1) {
                        for (j = dx[dmax].ijmp; j >= 0 && dx[dmax].jp.x[j] >= xx; j--)
                                ;
```

Table 1 (cont')

...readjmps

```
            if (j < 0 && dx[dmax].offset && fj) {
                (void) lseek(fd, dx[dmax].offset, 0);
                (void) read(fd, (char *)&dx[dmax].jp, sizeof(struct jmp));
                (void) read(fd, (char *)&dx[dmax].offset, sizeof(dx[dmax].offset));
                dx[dmax].ijmp = MAXJMP-1;
            }
            else
                break;
        }
        if (i >= JMPS) {
            fprintf(stderr, "%s: too many gaps in alignment\n", prog);
            cleanup(1);
        }
        if (j >= 0) {
            siz = dx[dmax].jp.n[j];
            xx = dx[dmax].jp.x[j];
            dmax += siz;
            if (siz < 0) {              /* gap in second seq */
                pp[1].n[i1] = -siz;
                xx += siz;
                /* id = xx - yy + len1 - 1
                */
                pp[1].x[i1] = xx - dmax + len1 - 1;
                gapy++;
                ngapy -= siz;
/* ignore MAXGAP when doing endgaps */
                siz = (-siz < MAXGAP || endgaps)? -siz : MAXGAP;
                i1++;
            }
            else if (siz > 0) {   /* gap in first seq */
                pp[0].n[i0] = siz;
                pp[0].x[i0] = xx;
                gapx++;
                ngapx += siz;
/* ignore MAXGAP when doing endgaps */
                siz = (siz < MAXGAP || endgaps)? siz : MAXGAP;
                i0++;
            }
        }
        else
            break;
    }

/* reverse the order of jmps
*/
    for (j = 0, i0--; j < i0; j++, i0--) {
        i = pp[0].n[j]; pp[0].n[j] = pp[0].n[i0]; pp[0].n[i0] = i;
        i = pp[0].x[j]; pp[0].x[j] = pp[0].x[i0]; pp[0].x[i0] = i;
    }
    for (j = 0, i1--; j < i1; j++, i1--) {
        i = pp[1].n[j]; pp[1].n[j] = pp[1].n[i1]; pp[1].n[i1] = i;
        i = pp[1].x[j]; pp[1].x[j] = pp[1].x[i1]; pp[1].x[i1] = i;
    }
    if (fd >= 0)
        (void) close(fd);
    if (fj) {
        (void) unlink(jname);
        fj = 0;
        offset = 0;
    }
}
```

Table 1 (cont')

```
/*
 * write a filled jmp struct offset of the prev one (if any): nw()
 */
writejmps(ix)
        writejmps
        int     ix;
{
        char    *mktemp();

if (!fj) {
                if (mktemp(jname) < 0) {
                        fprintf(stderr, "%s: can't mktemp() %s\n", prog, jname);
                        cleanup(1);
                }
                if ((fj = fopen(jname, "w")) == 0) {
                        fprintf(stderr, "%s: can't write %s\n", prog, jname);
                        exit(1);
                }
        }
        (void) fwrite((char *)&dx[ix].jp, sizeof(struct jmp), 1, fj);
        (void) fwrite((char *)&dx[ix].offset, sizeof(dx[ix].offset), 1, fj);
}
```

TABLE 2

| | | |
|---|---|---|
| PRO | XXXXXXXXXXXXXXX | (Length = 15 amino acids) |
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the PRO polypeptide) = 5 divided by 15 = 33.3%

TABLE 3

| | | |
|---|---|---|
| PRO | XXXXXXXXXX | (Length = 10 amino acids) |
| Comparison Protein | XXXXXYYYYYYZZYZ | (Length = 15 amino acids) |

% amino acid sequence identity = (the number of identically matching amino acid residues between the two polypeptide sequences as determined by ALIGN-2) divided by (the total number of amino acid residues of the PRO polypeptide) = 5 divided by 10 = 50%

TABLE 4

| | | |
|---|---|---|
| PRO-DNA | NNNNNNNNNNNNNN | (Length = 14 nucleotides) |
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 6 divided by 14 = 42.9%

TABLE 5

| | | |
|---|---|---|
| PRO-DNA | NNNNNNNNNNNN | (Length = 12 nucleotides) |
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 4 divided by 12 = 33.3%

II. Compositions and Methods of the Invention

A. Full-Length PRO Polypeptides

The present invention provides newly identified and isolated nucleotide sequences encoding polypeptides referred to in the present application as PRO polypeptides. In particular, cDNAs encoding various PRO polypeptides have been identified and isolated, as disclosed in further detail in the Examples below. However, for sake of simplicity, in the present specification the protein encoded by the full length native nucleic acid molecules disclosed herein as well as all further native homologues and variants included in the foregoing definition of PRO, will be referred to as "PRO/number", regardless of their origin or mode of preparation.

As disclosed in the Examples below, various cDNA clones have been disclosed. The predicted amino acid sequence can be determined from the nucleotide sequence using routine skill. For the PRO polypeptides and encoding nucleic acids described herein, Applicants have identified what is believed to be the reading frame best identifiable with the sequence information available at the time.

B. PRO Polypeptide Variants

In addition to the full-length native sequence PRO polypeptides described herein, it is contemplated that PRO variants can be prepared. PRO variants can be prepared by introducing appropriate nucleotide changes into the PRO DNA, and/or by synthesis of the desired PRO polypeptide. Those skilled in the art will appreciate that amino acid changes may alter post-translational processes of the PRO, such as changing the number or position of glycosylation sites or altering the membrane anchoring characteristics.

Variations in the native full-length sequence PRO or in various domains of the PRO described herein, can be made, for example, using any of the techniques and guidelines for conservative and non-conservative mutations set forth, for instance, in U.S. Pat. No. 5,364,934. Variations may be a substitution, deletion or insertion of one or more codons encoding the PRO that results in a change in the amino acid sequence of the PRO as compared with the native sequence PRO. Optionally, the variation is by substitution of at least one amino acid with any other amino acid in one or more of the domains of the PRO. Guidance in determining which amino acid residue may be inserted, substituted or deleted without adversely affecting the desired activity may be found by comparing the sequence of the PRO with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

PRO polypeptide fragments are provided herein. Such fragments may be truncated at the N-terminus or C-terminus, or may lack internal residues, for example, when compared with a full length native protein. Certain fragments lack amino acid residues that are not essential for a desired biological activity of the PRO polypeptide.

PRO fragments may be prepared by any of a number of conventional techniques. Desired peptide fragments may be chemically synthesized. An alternative approach involves generating PRO fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide fragment, by polymerase chain reaction (PCR). Oligonucleotides that define the desired termini of the DNA fragment are employed at the 5' and 3' primers in the PCR. Preferably, PRO polypeptide fragments share at least one biological and/or immunological activity with the native PRO polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |

TABLE 6-continued

| Original Residue | Exemplary Substitutions | Preferred Substitutions |
|---|---|---|
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the PRO polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) hydrophobic: norleucine, met, ala, val, leu, ile;
(2) neutral hydrophilic: cys, ser, thr;
(3) acidic: asp, glu;
(4) basic: asn, gin, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.*, 13.4331 (1986); Zoller et al., *Nucl. Acids Res.*, 10:6487 (1987)], cassette mutagenesis [Wells et al., *Gene*, 34:315 (1985)], restriction selection mutagenesis [Wells et al., *Philos. Trans. R. Soc. London SerA*, 317:415 (1986)] or other known techniques can be performed on the cloned DNA to produce the PRO variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science*, 244: 1081-1085 (1989)]. Alanine is also typically preferred because it is the most common amino acid. Further, it is frequently found in both buried and exposed positions [Creighton, *The Proteins*, (W.H. Freeman & Co., N.Y.); Chothia, *J. Mol. Biol.*, 150:1 (1976)]. If alanine substitution does not yield adequate amounts of variant, an isoteric amino acid can be used.

C. Modifications of PRO

Covalent modifications of PRO are included within the scope of this invention. One type of covalent modification includes reacting targeted amino acid residues of a PRO polypeptide with an organic derivatizing agent that is capable of reacting with selected side chains or the N- or C-terminal residues of the PRO. Derivatization with bifunctional agents is useful, for instance, for crosslinking PRO to a water-insoluble support matrix or surface for use in the method for purifying anti-PRO antibodies, and vice-versa. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the α-amino groups of lysine, arginine, and histidine side chains [T. E. Creighton, *Proteins: Structure and Molecular Properties*, W.H. Freeman & Co., San Francisco, pp. 79-86 (1983)], acetylation of the N-terminal amine, and amidation of any C-terminal carboxyl group.

Another type of covalent modification of the PRO polypeptide included within the scope of this invention comprises altering the native glycosylation pattern of the polypeptide. "Altering the native glycosylation pattern" is intended for purposes herein to mean deleting one or more carbohydrate moieties found in native sequence PRO (either by removing the underlying glycosylation site or by deleting the glycosylation by chemical and/or enzymatic means), and/or adding one or more glycosylation sites that are not present in the native sequence PRO. In addition, the phrase includes qualitative changes in the glycosylation of the native proteins, involving a change in the nature and proportions of the various carbohydrate moieties present.

Addition of glycosylation sites to the PRO polypeptide may be accomplished by altering the amino acid sequence. The alteration may be made, for example, by the addition of, or substitution by, one or more serine or threonine residues to the native sequence PRO (for O-linked glycosylation sites). The PRO amino acid sequence may optionally be altered through changes at the DNA level, particularly by mutating the DNA encoding the PRO polypeptide at preselected bases such that codons are generated that will translate into the desired amino acids.

Another means of increasing the number of carbohydrate moieties on the PRO polypeptide is by chemical or enzymatic coupling of glycosides to the polypeptide. Such methods are described in the art, e.g., in WO 87/05330 published 11 Sep. 1987, and in Aplin and Wriston, *CRC Crit. Rev. Biochem.*, pp. 259-306 (1981).

Removal of carbohydrate moieties present on the PRO polypeptide may be accomplished chemically or enzymatically or by mutational substitution of codons encoding for amino acid residues that serve as targets for glycosylation. Chemical deglycosylation techniques are known in the art and described, for instance, by Hallimuddin, et al., *Arch. Biochem. Biophys.*, 259:52 (1987) and by Edge et al., *Anal. Biochem.*, 118:131 (1981). Enzymatic cleavage of carbohydrate moieties on polypeptides can be achieved by the use of a variety of endo- and exo-glycosidases as described by Thotakira et al., *Meth. Enzymol.*, 138:350 (1987).

Another type of covalent modification of PRO comprises linking the PRO polypeptide to one of a variety of nonproteinaceous polymers, e.g., polyethylene glycol (PEG), polypropylene glycol, or polyoxyalkylenes, in the manner set forth in U.S. Pat. No. 4,640,835; 4,496,689; 4,301,144; 4,670,417; 4,791,192 or 4,179,337.

The PRO of the present invention may also be modified in a way to form a chimeric molecule comprising PRO fused to another, heterologous polypeptide or amino acid sequence.

In one embodiment, such a chimeric molecule comprises a fusion of the PRO with a tag polypeptide which provides an epitope to which an anti-tag antibody can selectively bind. The epitope tag is generally placed at the amino- or carboxyl-terminus of the PRO. The presence of such epitope-tagged forms of the PRO can be detected using an antibody against the tag polypeptide. Also, provision of the epitope tag enables the PRO to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.*, 8:2159-2165 (1988)]; the c-myc tag and the 8F9, 3C7, 6E10, G4, B7 and 9E10 antibodies thereto [Evan et al., *Molecular and Cellular Biology*, 5:3610-3616 (1985)]; and the Herpes Simplex virus glycoprotein D (gD) tag and its antibody [Paborsky et al., *Protein Engineering*, 3(6):547-553 (1990)]. Other tag polypeptides include the Flag-peptide [Hopp et al., *BioTechnology*, 6:1204-1210 (1988)]; the KT3 epitope peptide [Martin et al., *Science*, 255:192-194 (1992)]; an alpha-tubulin epitope peptide [Skinner et al., *J. Biol. Chem.*, 266:15163-15166 (1991)]; and the T7 gene 10 protein peptide tag [Lutz-Freyermuth et al., *Proc. Natl. Acad. Sci. USA*, 87:6393-6397 (1990)].

In an alternative embodiment, the chimeric molecule may comprise a fusion of the PRO with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PRO polypeptide in place of at least one variable region within an Ig molecule. In a particularly preferred embodiment, the immunoglobulin fusion includes the hinge, CH2 and CH3, or the hinge, CH1, CH2 and CH3 regions of an IgG1 molecule. For the production of immunoglobulin fusions see also U.S. Pat. No. 5,428,130 issued Jun. 27, 1995.

D. Preparation of PRO

The description below relates primarily to production of PRO by culturing cells transformed or transfected with a vector containing PRO nucleic acid. It is, of course, contemplated that alternative methods, which are well known in the art, may be employed to prepare PRO. For instance, the PRO sequence, or portions thereof, may be produced by direct peptide synthesis using solid-phase techniques [see, e.g., Stewart et al., *Solid-Phase Peptide Synthesis*, W.H. Freeman Co., San Francisco, Calif. (1969); Merrifield, *J. Am. Chem. Soc.*, 85:2149-2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the PRO may be chemically synthesized separately and combined using chemical or enzymatic methods to produce the full-length PRO.

1. Isolation of DNA Encoding PRO

DNA encoding PRO may be obtained from a cDNA library prepared from tissue believed to possess the PRO mRNA and to express it at a detectable level. Accordingly, human PRO DNA can be conveniently obtained from a cDNA library prepared from human tissue, such as described in the Examples. The PRO-encoding gene may also be obtained from a genomic library or by known synthetic procedures (e.g., automated nucleic acid synthesis).

Libraries can be screened with probes (such as antibodies to the PRO or oligonucleotides of at least about 20-80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding PRO is to use PCR methodology [Sambrook et al., supra Dieffenbach et al., *PCR Primer: A Laboratory Manual* (Cold Spring Harbor Laboratory Press, 1995)].

The Examples below describe techniques for screening a cDNA library. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for PRO production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell Biotechnology: a Practical Approach*, M. Butler, ed. (IRL Press, 1991) and Sambrook et al., supra.

Methods of eukaryotic cell transfection and prokaryotic cell transformation are known to the ordinarily skilled artisan, for example, $CaCl_2$, $CaPO_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., *Gene*, 23:315 (1983) and WO 89/05859 published 29 Jun. 1989. For mammalian cells without such cell walls, the calcium phosphate precipitation method of Graham and van der Eb, *Virology*, 52:456-457 (1978) can be employed. General aspects of mammalian cell host system transfections have been described in U.S. Pat.

No. 4,399,216. Transformations into yeast are typically carried out according to the method of Van Solingen et al., *J. Bact.*, 130:946 (1977) and Hsiao et al., *Proc. Natl. Acad. Sci. (USA)*, 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology*, 185:527-537 (1990) and Mansour et al., *Nature*, 336:348-352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325) and K5 772 (ATCC 53,635). Other suitable prokaryotic host cells include Enterobacteriaceae such as *Escherichia*, e.g., *E. coli*, *Enterobacter*, *Erwinia*, *Klebsiella*, *Proteus*, *Salmonella*, e.g., *Salmonella typhimurium*, *Serratia*, e.g., *Serratia marcescans*, and *Shigella*, as well as *Bacilli* such as *B. subtilis* and *B. licheniformis* (e.g., *B. licheniformis* 41P disclosed in DD 266,710 published 12 Apr. 1989), *Pseudomonas* such as *P. aeruginosa*, and *Streptomyces*. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3; *E. coli* W3110 strain 27C7 (ATCC 55,244), which has the complete genotype tonA ptr3 phoA E15 (argF-lac)169 degP ompT kan$^r$; *E. coli* W3110 strain 37D6, which has the complete genotype tonA ptr3 phoA E15 (argF-lac)169 degP ompT rbs7 ilvG kan$^r$; *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued 7 Aug. 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for PRO-encoding vectors. *Saccharomyces cerevisiae* is a commonly used lower eukaryotic host microorganism. Others include *Schizosaccharomyces pombe* (Beach and Nurse, *Nature*, 290: 140 [1981]; EP 139,383 published 2 May 1985); *Kluyveromyces* hosts (U.S. Pat. No. 4,943,529; Fleer et al., *Bio/Technology*, 9:968-975 (1991)) such as, e.g., *K. lactis* (MW98-8C, CBS683, CBS4574; Louvencourt et al., *J. Bacteriol.*, 154(2):737-742 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., *Bio/Technology*, 8:135 (1990)), *K. thermotolerans*, and *K. marxianus; yarrowia* (EP 402,226); *Pichia pastoris* (EP 183,070; Sreekrishna et al., *J. Basic Microbiol.* 28:265-278 [1988]); *Candida; Trichoderma reesia* (EP 244,234); *Neurospora crassa* (Case et al., *Proc. Natl. Acad. Sci. USA*, 76:5259-5263 [1979]); *Schwanniomyces* such as *Schwanniomyces occidentalis* (EP 394,538 published 31 Oct. 1990); and filamentous fungi such as, e.g., *Neurospora*, *Penicillium*, *Tolypocladiun* (WO 91/00357 published 10 Jan. 1991), and *Aspergillus* hosts such as *A. nidulans* (Ballance et al., *Biochem. Biophys. Res. Commun.*, 112: 284-289 [1983]; Tilburn et al., *Gene*, 26:205-221 [1983]; Yelton et al., *Proc. Natl. Acad. Sci. USA*, 81: 1470-1474 [1984]) and *A. niger* (Kelly and Hynes, *EMBO J.*, 4:475-479 [1985]). Methylotropic yeasts are suitable herein and include, but are not limited to, yeast capable of growth on methanol selected from the genera consisting of *Hansenula*, *Candida*, *Kloeckera*, *Pichia*, *Saccharomyces*, *Torulopsis*, and *Rhodotorula*. A list of specific species that are exemplary of this class of yeasts may be found in C. Anthony, *The Biochemistry of Methylotrophs*. 269 (1982).

Suitable host cells for the expression of glycosylated PRO are derived from multicellular organisms. Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., *J. Gen Virol.*, 36:59 (1977)); Chinese hamster ovary cells/− DHFR (CHO, Urlaub and Chasin, *Proc. Natl. Acad. Sci. USA*, 77:4216 (1980)); mouse sertoli cells (TM4, Mather, *Biol. Reprod.*, 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

3. Selection and Use of a Replicable Vector

The nucleic acid (e.g., cDNA or genomic DNA) encoding PRO may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The PRO may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the PRO-encoding DNA that is inserted into the vector. The signal sequence may be a prokaryotic signal sequence selected, for example, from the group of the alkaline phosphatase, penicillinase, lpp, or heat-stable enterotoxin II leaders. For yeast secretion the signal sequence may be, e.g., the yeast invertase leader, alpha factor leader (including *Saccharomyces* and *Kluyveromyces* α-factor leaders, the latter described in U.S. Pat. No. 5,010,182), or acid phosphatase leader, the *C. albicans* glucoamylase leader (EP 362,179 published 4 Apr. 1990), or the signal described in WO 90/13646 published 15 Nov. 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the PRO-encoding nucleic acid, such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA,* 77:4216 (1980). A suitable selection gene for use in yeast is the trp1 gene present in the yeast plasmid YRp7 [Stinchcomb et al., *Nature,* 282:39 (1979); Kingsman et al., *Gene,* 7:141 (1979); Tschemper et al., *Gene,* 10: 157 (1980)]. The tips gene provides a selection marker for a mutant strain of yeast lacking the ability to grow in tryptophan, for example, ATCC No. 44076 or PEP4-1 [Jones, *Genetics,* 85:12 (1977)].

Expression and cloning vectors usually contain a promoter operably linked to the PRO-encoding nucleic acid sequence to direct mRNA synthesis. Promoters recognized by a variety of potential host cells are well known. Promoters suitable for use with prokaryotic hosts include the β-lactamase and lactose promoter systems [Chang et al., *Nature,* 275:615 (1978); Goeddel et al., *Nature,* 281:544 (1979)], alkaline phosphatase, a tryptophan (trp) promoter system [Goeddel, *Nucleic Acids Res.,* 8:4057 (1980); EP 36,776], and hybrid promoters such as the tac promoter [deBoer et al., *Proc. Natl. Acad. Sci. USA,* 80:21-25 (1983)]. Promoters for use in bacterial systems also will contain a Shine-Dalgarno (S.D.) sequence operably lined to the DNA encoding PRO.

Examples of suitable promoting sequences for use with yeast hosts include the promoters for 3-phosphoglycerate kinase [Hitzeman et al., *J. Biol. Chem.,* 255:2073 (1980)] or other glycolytic enzymes [Hess et al., *J. Adv. Enzyme Reg.,* 7:149 (1968); Holland, *Biochemistry,* 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

PRO transcription from vectors in mammalian host cells is controlled, for example, by promoters obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the PRO by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. The enhancer may be spliced into the vector at a position 5' or 3' to the PRO coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding PRO.

Still other methods, vectors, and host cells suitable for adaptation to the synthesis of PRO in recombinant vertebrate cell culture are described in Gething et al., *Nature,* 293:620-625 (1981); Mantei et al., *Nature,* 281:40-46 (1979); EP 117,060; and EP 117,058.

4. Detecting Gene Amplification/Expression

Gene amplification and/or expression may be measured in a sample directly, for example, by conventional Southern blotting, Northern blotting to quantitate the transcription of mRNA [Thomas, *Proc. Natl. Acad. Sci. USA,* 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence PRO polypeptide or against a synthetic peptide based on the DNA sequences provided herein or against exogenous sequence fused to PRO DNA and encoding a specific antibody epitope.

5. Purification of Polypeptide

Forms of PRO may be recovered from culture medium or from host cell lysates. If membrane-bound, it can be released from the membrane using a suitable detergent solution (e.g. Triton-X 100) or by enzymatic cleavage. Cells employed in expression of PRO can be disrupted by various physical or chemical means, such as freeze-thaw cycling, sonication, mechanical disruption, or cell lysing agents.

It may be desired to purify PRO from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the PRO. Various methods of protein purification may be employed and such methods are known in the art and described for example in Deutscher, *Methods in Enzymology*, 182 (1990); Scopes, *Protein Purification: Principles and Practice*, Springer-Verlag, New York (1982). The purification step(s) selected will depend, for example, on the nature of the production process used and the particular PRO produced.

E. Tissue Distribution

The location of tissues expressing the PRO can be identified by determining mRNA expression in various human tissues. The location of such genes provides information about which tissues are most likely to be affected by the stimulating and inhibiting activities of the PRO polypeptides. The location of a gene in a specific tissue also provides sample tissue for the activity blocking assays discussed below.

As noted before, gene expression in various tissues may be measured by conventional Southern blotting, Northern blotting to quantitate the transcription of mRNA (Thomas, *Proc. Natl. Acad. Sci. USA*, 77:5201-5205 [1980]), dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes.

Gene expression in various tissues, alternatively, may be measured by immunological methods, such as immunohistochemical staining of tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence of a PRO polypeptide or against a synthetic peptide based on the DNA sequences encoding the PRO polypeptide or against an exogenous sequence fused to a DNA encoding a PRO polypeptide and encoding a specific antibody epitope. General techniques for generating antibodies, and special protocols for Northern blotting and in situ hybridization are provided below.

F. Antibody Binding Studies

The activity of the PRO polypeptides can be further verified by antibody binding studies, in which the ability of anti-PRO antibodies to inhibit the effect of the PRO polypeptides, respectively, on tissue cells is tested. Exemplary antibodies include polyclonal, monoclonal, humanized, bispecific, and heteroconjugate antibodies, the preparation of which will be described hereinbelow.

Antibody binding studies may be carried out in any known assay method, such as competitive binding assays, direct and indirect sandwich assays, and immunoprecipitation assays. Zola, *Monoclonal Antibodies: A Manual of Techniques*, pp. 147-158 (CRC Press, Inc., 1987).

Competitive binding assays rely on the ability of a labeled standard to compete with the test sample analyte for binding with a limited amount of antibody. The amount of target protein in the test sample is inversely proportional to the amount of standard that becomes bound to the antibodies. To facilitate determining the amount of standard that becomes bound, the antibodies preferably are insolubilized before or after the competition, so that the standard and analyte that are bound to the antibodies may conveniently be separated from the standard and analyte which remain unbound.

Sandwich assays involve the use of two antibodies, each capable of binding to a different immunogenic portion, or epitope, of the protein to be detected. In a sandwich assay, the test sample analyte is bound by a first antibody which is immobilized on a solid support, and thereafter a second antibody binds to the analyte, thus forming an insoluble three-part complex. See, e.g., U.S. Pat. No. 4,376,110. The second antibody may itself be labeled with a detectable moiety (direct sandwich assays) or may be measured using an anti-immunoglobulin antibody that is labeled with a detectable moiety (indirect sandwich assay). For example, one type of sandwich assay is an ELISA assay, in which case the detectable moiety is an enzyme.

For immunohistochemistry, the tissue sample may be fresh or frozen or may be embedded in paraffin and fixed with a preservative such as formalin, for example.

G. Cell-Based Assays

Cell-based assays and animal models for immune related diseases can be used to further understand the relationship between the genes and polypeptides identified herein and the development and pathogenesis of immune related disease.

In a different approach, cells of a cell type known to be involved in a particular immune related disease are transfected with the cDNAs described herein, and the ability of these cDNAs to stimulate or inhibit immune function is analyzed. Suitable cells can be transfected with the desired gene, and monitored for immune function activity. Such transfected cell lines can then be used to test the ability of poly- or monoclonal antibodies or antibody compositions to inhibit or stimulate immune function, for example to modulate T-cell proliferation or inflammatory cell infiltration. Cells transfected with the coding sequences of the genes identified herein can further be used to identify drug candidates for the treatment of immune related diseases.

In addition, primary cultures derived from transgenic animals (as described below) can be used in the cell-based assays herein, although stable cell lines are preferred. Techniques to derive continuous cell lines from transgenic animals are well known in the art (see, e.g., Small et al., *Mol. Cell. Biol.* 5: 642-648 [1985])

An example of one suitable cell based assay is the mixed lymphocyte reaction (MLR). *Current Protocols in Immunology*, unit 3.12; edited by J E Coligan, A M Kruisbeek, D H Marglies, E M Shevach, W Strober, National Institutes of Health, Published by John Wiley & Sons, Inc. In this assay, the ability of a test compound to stimulate or inhibit the proliferation of activated T cells is assayed. A suspension of responder T cells is cultured with allogeneic stimulator cells and the proliferation of T cells is measured by uptake of tritiated thymidine. This assay is a general measure of T cell reactivity. Since the majority of T cells respond to and produce IL-2 upon activation, differences in responsiveness in this assay in part reflect differences in IL-2 production by the responding cells. The MLR results can be verified by a standard lymphokine (IL-2) detection assay. Current Protocols in Immunology, above, 3.15, 6.3.

Direct use of a stimulating compound as in the invention has been validated in experiments with 4-1BB glycoprotein, a member of the tumor necrosis factor receptor family, which binds to a ligand (4-1BBL) expressed on primed T cells and signals T cell activation and growth. Alderson, M. E. et al., *J. Immunol.* (1994) 24:2219.

The use of an agonist stimulating compound has also been validated experimentally. Activation of 4-1BB by treatment with an agonist anti-4-1BB antibody enhances eradication of tumors. Hellstrom, I. and Hellstrom, K. E., *Cit. Rev. Immunol.* (1998) 18:1. Immunoadjuvant therapy for treatment of tumors, described in more detail below, is another example of the use of the stimulating compounds of the invention.

Alternatively, an immune stimulating or enhancing effect can also be achieved by administration of a PRO which has vascular permeability enhancing properties. Enhanced vascular permeability would be beneficial to disorders which can be attenuated by local infiltration of immune cells (e.g., monocytes, eosinophils, PMNs) and inflammation.

On the other hand, PRO polypeptides, as well as other compounds of the invention, which are direct inhibitors of immune cell proliferation/activation, lymphokine secretion, and/or vascular permeability can be directly used to suppress the immune response. These compounds are useful to reduce the degree of the immune response and to treat immune related diseases characterized by a hyperactive, superoptimal, or autoimmune response such as RA. This use of the compounds of the invention has been validated by the experiments described above in which CTLA-4 binding to receptor B7 deactivates T cells. The direct inhibitory compounds of the invention function in an analogous manner. The use of a compound which suppress vascular permeability would be expected to reduce inflammation. Such uses would be beneficial in treating conditions associated with excessive inflammation.

Alternatively, compounds, e.g., antibodies, which bind to stimulating PRO polypeptides and block the stimulating effect of these molecules produce a net inhibitory effect and can be used to suppress the cell mediated immune response by inhibiting immune cell proliferation/activation and/or lymphokine secretion. Blocking the stimulating effect of the polypeptides suppresses the immune response of the mammal. This use has been validated in experiments using an anti-12 antibody. In these experiments, the antibody binds to IL-2 and blocks binding of IL-2 to its receptor thereby achieving a T cell inhibitory effect.

H. Animal Models

The results of the cell based in vitro assays can be further verified using in vivo animal models and assays for immune cell function. A variety of well known animal models can be used to further understand the role of the genes identified herein in the development and pathogenesis of immune related disease, and to test the efficacy of candidate therapeutic agents, including antibodies, and other antagonists of the native polypeptides, including small molecule antagonists. The in vivo nature of such models makes them predictive of responses in human patients. Animal models of immune related diseases include both non-recombinant and recombinant (transgenic) animals. Non-recombinant animal models include, for example, rodent, e.g., murine models. Such models can be generated by introducing cells into syngeneic mice using standard techniques, e.g., subcutaneous injection, tail vein injection, spleen implantation, intraperitoneal implantation, implantation under the renal capsule, etc.

Graft-versus-host disease occurs when immunocompetent cells are transplanted into immunosuppressed or tolerant patients. The donor cells recognize and respond to host antigens. The response can vary from life threatening severe inflammation to mild cases of diarrhea and weight loss. Graft-versus-host disease models provide a means of assessing immune cell reactivity against MHC antigens and minor transplant antigens. A suitable procedure is described in detail in Current Protocols in Immunology, above, unit 4.3.

An animal model for skin allograft rejection is a means of testing the ability of T cells to mediate in vivo tissue destruction and a measure of their role in transplant rejection. The most common and accepted models use murine tail-skin grafts. Repeated experiments have shown that skin allograft rejection is mediated by T cells, helper T cells and killer-effector T cells, and not antibodies. Auchincloss, H. Jr. and Sachs, D. H., *Fundamental Immunology*, 2nd ed., W. E. Paul ed., Raven Press, NY, 1989, 889-992. A suitable procedure is described in detail in *Current Protocols in Immunology*, above, unit 4.4. Other transplant rejection models which can be used to test the compounds of the invention are the allogeneic heart transplant models described by Tanabe, M. et al, *Transplantation* (1994) 58:23 and Tinubu, S. A. et at, *J. Immunol.* (1994) 4330-4338.

An animal model for arthritis is collagen-induced arthritis. This model shares clinical, histological and immunological characteristics of human autoimmune rheumatoid arthritis and is an acceptable model for human autoimmune arthritis. Mouse and rat models are characterized by synovitis, erosion of cartilage and subchondral bone. The compounds of the invention can be tested for activity against autoimmune arthritis using the protocols described in *Current Protocols in Immunology*, above, units 15.5. See also the model using a monoclonal antibody to CD18 and VLA-4 integrins described in Issekutz, A. C. et al., *Immunology* (1996) 88:569.

Recombinant (transgenic) animal models can be engineered by introducing the coding portion of the genes identified herein into the genome of animals of interest, using standard techniques for producing transgenic animals. Animals that can serve as a target for transgenic manipulation include, without limitation, mice, rats, rabbits, guinea pigs, sheep, goats, pigs, and non-human primates, e.g., baboons, chimpanzees and monkeys. Techniques known in the art to introduce a transgene into such animals include pronucleic microinjection (Hoppe and Wanger, U.S. Pat. No. 4,873,191); retrovirus-mediated gene transfer into germ lines (e.g., Van der Putten et al., *Proc. Natl. Acad. Sci. USA* 82, 6148-615 [1985]); gene targeting in embryonic stem cells (Thompson et al., *Cell* 56, 313-321 [1989]); electroporation of embryos (Lo, *Mol. Cel. Biol.* 3, 1803-1814 [1983]); sperm-mediated gene transfer (Lavitrano et al., *Cell* 57, 717-73 [1989]). For review, see, for example, U.S. Pat. No. 4,736,866.

For the purpose of the present invention, transgenic animals include those that carry the transgene only in part of their cells ("mosaic animals"). The transgene can be integrated either as a single transgene, or in concatamers, e.g., head-to-head or head-to-tail tandems. Selective introduction of a transgene into a particular cell type is also possible by following, for example, the technique of Lasko et al., *Proc. Natl. Acad. Sci. USA* 89, 6232-636 (1992).

The expression of the transgene in transgenic animals can be monitored by standard techniques. For example, Southern blot analysis or PCR amplification can be used to verify the integration of the transgene. The level of mRNA expression can then be analyzed using techniques such as in situ hybridization, Northern blot analysis, PCR, or immunocytochemistry.

The animals may be further examined for signs of immune disease pathology, for example by histological examination to determine infiltration of immune cells into specific tissues. Blocking experiments can also be performed in which the transgenic animals are treated with the compounds of the invention to determine the extent of the immune cell proliferation/stimulation or inhibition of the compounds. In these experiments, blocking antibodies which bind to the PRO polypeptide, prepared as described above, are administered to the animal and the effect on immune function is determined.

Alternatively, "knock out" animals can be constructed which have a defective or altered gene encoding a polypeptide identified herein, as a result of homologous recombination between the endogenous gene encoding the polypeptide and altered genomic DNA encoding the same polypeptide introduced into an embryonic cell of the animal. For example, cDNA encoding a particular polypeptide can be used to clone genomic DNA encoding that polypeptide in accordance with established techniques. A portion of the genomic DNA encoding a particular polypeptide can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, Cell, 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., Cell, 69:915 (1992)]. The selected cells are then injected into a blastocyst of an animal (e.g., a mouse or rat) to form aggregation chimeras [see e.g., Bradley, in Teratocarcinomas and Embryonic Stem Cells: A Practical Approach, E. J. Robertson, ed. (IRL, Oxford, 1987), pp. 113-152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knockout animals can be characterized for instance, for their ability to defend against certain pathological conditions and for their development of pathological conditions due to absence of the polypeptide.

I. ImmunoAdjuvant Therapy

In one embodiment, the immunostimulating compounds of the invention can be used in immunoadjuvant therapy for the treatment of tumors (cancer). It is now well established that immune cells recognize human tumor specific antigens. One group of tumor antigens, encoded by the MAGE, BAGE and GAGE families of genes, are silent in all adult normal tissues, but are expressed in significant amounts in tumors, such as melanomas, lung tumors, head and neck tumors, and bladder carcinomas. DeSmet, C. et al., (1996) Proc. Natl. Acad. Sci. USA, 93:7149. It has been shown that costimulation of T cells induces tumor regression and an antitumor response both in vitro and in vivo. Melero, I. et al., Nature Medicine (1997) 3:682; Kwon, E. D. et al., Proc. Natl. Acad. Sci. USA (1997) 94: 8099; Lynch, D. H. et al, Nature Medicine (1997) 3:625; Finn, O. J. and Lotze, M. T., J. Immunol. (1998) 21:114. The stimulatory compounds of the invention can be administered as adjuvants, alone or together with a growth regulating agent, cytotoxic agent or chemotherapeutic agent, to stimulate immune cell proliferation/activation and an antitumor response to tumor antigens. The growth regulating, cytotoxic, or chemotherapeutic agent may be administered in conventional amounts using known administration regimes. Immunostimulating activity by the compounds of the invention allows reduced amounts of the growth regulating, cytotoxic, or chemotherapeutic agents thereby potentially lowering the toxicity to the patient.

J. Screening Assays for Drug Candidates

Screening assays for drug candidates are designed to identify compounds that bind to or complex with the polypeptides encoded by the genes identified herein or a biologically active fragment thereof, or otherwise interfere with the interaction of the encoded polypeptides with other cellular proteins. Such screening assays will include assays amenable to high-throughput screening of chemical libraries, making them particularly suitable for identifying small molecule drug candidates. Small molecules contemplated include synthetic organic or inorganic compounds, including peptides, preferably soluble peptides, (poly)peptide-immunoglobulin fusions, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. The assays can be performed in a variety of formats, including protein-protein binding assays, biochemical screening assays, immunoassays and cell based assays, which are well characterized in the art. All assays are common in that they call for contacting the drug candidate with a polypeptide encoded by a nucleic acid identified herein under conditions and for a time sufficient to allow these two components to interact.

In binding assays, the interaction is binding and the complex formed can be isolated or detected in the reaction mixture. In a particular embodiment, the polypeptide encoded by the gene identified herein or the drug candidate is immobilized on a solid phase, e.g., on a microliter plate, by covalent or non-covalent attachments. Non-covalent attachment generally is accomplished by coating the solid surface with a solution of the polypeptide and drying. Alternatively, an immobilized antibody, e.g., a monoclonal antibody, specific for the polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labelled antibody specifically binding the immobilized complex.

If the candidate compound interacts with but does not bind to a particular protein encoded by a gene identified herein, its interaction with that protein can be assayed by methods well known for detecting protein-protein interactions. Such assays include traditional approaches, such as, cross-linking, co-immunoprecipitation, and co-purification through gradients or chromatographic columns. In addition, protein-protein interactions can be monitored by using a yeast-based genetic system described by Fields and co-workers [Fields and Song, Nature (London) 340, 245-246 (1989); Chien et al., Proc. Natl. Acad. Sci. USA 88, 9578-9582 (1991)] as disclosed by Chevray and Nathans, Proc. Natl. Acad. Sci. USA 89, 5789-5793 (1991). Many transcriptional activators, such as yeast GAL4, consist of two physically discrete modular domains, one acting as the DNA-binding domain, while the other one functioning as the transcription activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAL4-activated promoter depends on reconstitution of GAL4 activity via protein-protein interaction. Colonies containing interacting polypeptides are detected with a chromogenic substrate for β-galactosidase. A complete kit (MATCHMAKER™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

In order to find compounds that interfere with the interaction of a gene identified herein and other intra- or extracellular components can be tested, a reaction mixture is usually prepared containing the product of the gene and the intra- or extracellular component under conditions and for a time allowing for the interaction and binding of the two products. To test the ability of a test compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described above. The formation of a complex in the control reaction(s) but not in the reaction mixture containing the test compound indicates that the test compound interferes with the interaction of the test compound and its reaction partner.

K. Compositions and Methods for the Treatment of Immune Related Diseases

The compositions useful in the treatment of immune related diseases include, without limitation, proteins, antibodies, small organic molecules, peptides, phosphopeptides, antisense and ribozyme molecules, triple helix molecules, etc. that inhibit or stimulate immune function, for example, immune cell proliferation/activation, lymphokine release, or immune cell infiltration.

For example, antisense RNA and RNA molecules act to directly block the translation of mRNA by hybridizing to targeted mRNA and preventing protein translation. When antisense DNA is used, oligodeoxyribonucleotides derived from the translation initiation site, e.g., between about −10 and +10 positions of the target gene nucleotide sequence, are preferred.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology* 4, 469-471 (1994), and PCT publication No. WO 97/33551 (published Sep. 18, 1997).

Nucleic acid molecules in triple helix formation used to inhibit transcription should be single-stranded and composed of deoxynucleotides. The base composition of these oligonucleotides is designed such that it promotes triple helix formation via Hoogsteen base pairing rules, which generally require sizeable stretches of purines or pyrimidines on one strand of a duplex. For further details see, e.g., PCT publication No. WO 97/33551, supra.

These molecules can be identified by any or any combination of the screening assays discussed above and/or by any other screening techniques well known for those skilled in the art.

L. Anti-PRO Antibodies

The present invention further provides anti-PRO antibodies. Exemplary antibodies include polyclonal, monoclonal, humanized, bispecific, and heteroconjugate antibodies.

1. Polyclonal Antibodies

The anti-PRO antibodies may comprise polyclonal antibodies. Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include the PRO polypeptide or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

2. Monoclonal Antibodies

The anti-PRO antibodies may, alternatively, be monoclonal antibodies. Monoclonal antibodies may be prepared using hybridoma methods, such as those described by Kohler and Milstein, *Nature*, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro.

The immunizing agent will typically include the PRO polypeptide or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59-103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.*, 133.3001 (1984); Brodeur et al., *Monoclonal Antibody Production Techniques and Applications*, Marcel Dekker, Inc., New York, (1987) pp. 51-63].

The culture medium in which the hybridoma cells are cultured can then be assayed for the presence of monoclonal antibodies directed against PRO. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980).

After the desired hybridoma cells are identified, the clones may be subcloned by limiting dilution procedures and grown by standard methods [Goding, supra]. Suitable culture media for this purpose include, for example, Dulbecco's Modified Eagle's Medium and RPMI-1640 medium. Alternatively, the hybridoma cells may be grown in vivo as ascites in a mammal.

The monoclonal antibodies secreted by the subclones may be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies may also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also may be modified, for example, by substituting the coding sequence for human heavy and light chain constant domains in place of the homologous murine sequences [U.S. Pat. No. 4,816,567; Morrison et al., supra] or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking.

In vitro methods are also suitable for preparing monovalent antibodies. Digestion of antibodies to produce fragments thereof, particularly, Fab fragments, can be accomplished using routine techniques known in the art.

3. Human and Humanized Antibodies

The anti-PRO antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature*, 321:522-525 (1986); Riechmann et al., *Nature*, 332:323-329 (1988); and Presta, *Curr. Op. Struct. Biol.*, 2:593-596 (1992)].

Methods for humanizing non-human antibodies are well known in the art. Generally, a humanized antibody has one or more amino acid residues introduced into it from a source which is nonhuman. These non-human amino acid residues are often referred to as "import" residues, which are typically taken from an "import" variable domain. Humanization can be essentially performed following the method of Winter and co-workers [Jones et al., *Nature*, 321:522-525 (1986); Riechmann et al., *Nature*, 332:323-327 (1988); Verhoeyen et al., *Science*, 239:1534-1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, *J. Mol. Biol.*, 227:381 (1991); Marks et al., *J. Mol. Biol.*, 222:581 (1991)]. The techniques of Cole et al. and Boerner et al. are also available for the preparation of human monoclonal antibodies (Cole et al., *Monoclonal Antibodies and Cancer Therapy*, Alan R. Liss, p. 77 (1985) and Boerner et al., *J. Immunol.*, 147(1):86-95 (1991)]. Similarly, human antibodies can be made by introducing of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., *Bio/Technology* 10, 779-783 (1992); Lonberg et al., *Nature* 368 856-859 (1994); Morrison, *Nature* 368, 812-13 (1994); Fishwild et al., *Nature Biotechnology* 14, 845-51 (1996); Neuberger, *Nature Biotechnology* 14, 826 (1996); Lonberg and Huszar, *Intern. Rev. Immunol.* 13 65-93 (1995).

The antibodies may also be affinity matured using known selection and/or mutagenesis methods as described above. Preferred affinity matured antibodies have an affinity which is five times, more preferably 10 times, even more preferably 20

4. Bispecific Antibodies

Bispecific antibodies are monoclonal, preferably human or humanized, antibodies that have binding specificities for at least two different antigens. In the present case, one of the binding specificities is for the PRO, the other one is for any other antigen, and preferably for a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities [Milstein and Cuello, Nature, 305:537-539 (1983)]. Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., EMBO J., 10:3655-3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., Methods in Enzymology, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared can be prepared using chemical linkage. Brennan et al., Science 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Fab' fragments may be directly recovered from E. coli and chemically coupled to form bispecific antibodies. Shalaby et al., J. Exp. Med. 175:217-225 (1992) describe the production of a fully humanized bispecific antibody F(ab')$_2$ molecule. Each Fab' fragment was separately secreted from E. coli and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various technique for making and isolating bispecific antibody fragments directly from recombinant cell culture have also been described. For example, bispecific antibodies have been produced using leucine zippers. Kostelny et al., J. Immunol. 148(5): 1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA 90:6444-6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., J. Immunol. 152:5368 (1994).

Antibodies with more than two valencies are contemplated. For example, trispecific antibodies can be prepared. Tutt et al., J. Immunol. 147:60 (1991).

Exemplary bispecific antibodies may bind to two different epitopes on a given PRO polypeptide herein. Alternatively, an anti-PRO polypeptide arm may be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular PRO polypeptide. Bispecific antibodies may also be used to localize cytotoxic agents to cells which express a particular PRO polypeptide. These antibodies possess a PRO-binding arm and an arm which binds a cytotoxic agent or a radionuclide chelator, such as EOTUBE, DPTA, DOTA, or TETA. Another bispecific antibody of interest binds the PRO polypeptide and further binds tissue factor (TF).

5. Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 92/200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

6. Effector Function Engineering

It may be desirable to modify the antibody of the invention with respect to effector function, so as to enhance, e.g., the effectiveness of the antibody in treating cancer. For example, cysteine residue(s) may be introduced into the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp. Med.,* 176: 1191-1195 (1992) and Shopes, *J. Immunol.,* 148: 2918-2922 (1992). Homodimeric antibodies with enhanced anti-tumor activity may also be prepared using heterobifunctional crosslinkers as described in Wolff et al. *Cancer Research,* 53: 2560-2565 (1993). Alternatively, an antibody can be engineered that has dual Fc regions and may thereby have enhanced complement lysis and ADCC capabilities. See Stevenson et al., *Anti-Cancer Drug Design,* 3: 219-230 (1989).

7. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{213}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol)propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis(p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science,* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody may be conjugated to a "receptor" (such streptavidin) for utilization in tumor pre-targeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

8. Immunoliposomes

The antibodies disclosed herein may also be formulated as immunoliposomes. Liposomes containing the antibody are prepared by methods known in the art, such as described in Epstein et al., *Proc. Natl. Acad. Sci. USA,* 82: 3688 (1985); Hwang et al., *Proc. Natl. Acad. Sci. USA,* 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.,* 257: 286-288 (1982) via a disulfide-interchange reaction. A chemotherapeutic agent (such as Doxorubicin) is optionally contained within the liposome. See Gabizon et al., *J. National Cancer Inst.,* 81(19): 1484 (1989).

M. Pharmaceutical Compositions

The active PRO molecules of the invention (e.g., PRO polypeptides, anti-PRO antibodies, and/or variants of each) as well as other molecules identified by the screening assays disclosed above, can be administered for the treatment of immune related diseases, in the form of pharmaceutical compositions.

Therapeutic formulations of the active PRO molecule, preferably a polypeptide or antibody of the invention, are prepared for storage by mixing the active molecule having the desired degree of purity with optional pharmaceutically acceptable carriers, excipients or stabilizers (*Remington's Pharmaceutical Sciences* 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

Compounds identified by the screening assays disclosed herein can be formulated in an analogous manner, using standard techniques well known in the art.

Lipofections or liposomes can also be used to deliver the PRO molecule into cells. Where antibody fragments are used, the smallest inhibitory fragment which specifically binds to the binding domain of the target protein is preferred. For example, based upon the variable region sequences of an antibody, peptide molecules can be designed which retain the ability to bind the target protein sequence. Such peptides can be synthesized chemically and/or produced by recombinant DNA technology (see, e.g., Marasco et al., *Proc. Natl. Acad. Sci. USA* 90, 7889-7893 [1993]).

The formulation herein may also contain more than one active compound as necessary for the particular indication being treated, preferably those with complementary activities that do not adversely affect each other. Alternatively, or in addition, the composition may comprise a cytotoxic agent, cytokine or growth inhibitory agent. Such molecules are suitably present in combination in amounts that are effective for the purpose intended.

The active PRO molecules may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences* 16th edition, Osol, A. Ed. (1980).

The formulations to be used for in vivo administration must be sterile. This is readily accomplished by filtration through sterile filtration membranes.

Sustained-release preparations or the PRO molecules may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethylmethacrylate), or poly(vinylalcohol)), polylactides (U.S. Pat. No. 3,773,919), copolymers of L-glutamic acid and γ-ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

N. Methods of Treatment

It is contemplated that the polypeptides, antibodies and other active compounds of the present invention may be used to treat various immune related diseases and conditions, such as immune cell mediated diseases, including those characterized by infiltration of inflammatory cells into a tissue, stimulation of immune cell proliferation, inhibition of immune-cell proliferation, increased or decreased vascular permeability or the inhibition thereof.

Exemplary conditions or disorders to be treated with the polypeptides, antibodies and other compounds of the invention, include, but are not limited to: systemic lupus erythematosis, rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune or immune-mediated skin diseases including bullous skin diseases, erythema multiforme and contact dermatitis, psoriasis, lymphadenopathy, splenomegaly and leukopenia.

Systemic Lupus erythematosis (SLE) is an autoimmune inflammatory connective tissue disease with variable symptomotology including fever, joint pains or arthritis resembling rheumatoid arthritis, erythematous skin lesions on the face, neck and upper torso. Cases that are more severe may include liquefaction degeneration of the basal layer and epidermal atrophy. For the past 30 years, cyclophosphamide has been used to treat SLE. Cyclophosphamide however, generally inhibits inflammation and has many side effects. Improvements in the understanding of the molecular events involved in the progression of SLE have lead to the trial of new therapeutic agents with less side effects and more efficacy due to the specific targeting of identified components of SLE. Therapeutics that are immunosuppressive are Mycophenolate Mofetil™ (MMF), Leflunomide™ and Tacrolimus™ (FK506). These molecules have a suppressive effect on the immune system, and in limited trials, have had fewer and less severe side effects than cyclophosphamide. Biological therapies such as Rituxan™, anti-C5b, anti-CD40L, anti-BLYS and anti-IL10, are all antibody therapies that have few side effects and target one specific molecule or pathway that is believed to be significant in the progression of SLE. Rituxan, for example, has been used to deplete B cells in SLE patients, and this correlated with improvements in arthritis, rash and fatigue. The biological therapies also have the advantage of being well tolerated, and can be used in combination with established agents such as cyclophosphamide. In the most severe cases of SLE, hematopoeitic stem cell replacement has caused remission in SLE patients, but the long-term results of these cell transplantations has not yet been determined. While cyclophosphamide has remained the major drug treatment of choice for SLE, the new therapies discussed herein that target specific aspects of SLE which may be the major affliction for that particular patient show great promise. The wider range of treatments now in development may mean improved control of this disease.

Transplantation associated diseases, including Graft rejection and Graft-Versus-Host-Disease (GVHD) are immune cell dependent; inhibition of immune cell function is ameliorative.

Other diseases in which intervention of the immune and/or inflammatory response have benefit are infectious disease including but not limited to viral infection (including but not limited to AIDS, hepatitis A, B, C, D, E and herpes) bacterial infection, fungal infections, and protozoal and parasitic infections Molecules (or derivatives/agonists) which stimulate the immune cell can be utilized therapeutically to enhance the immune response to infectious agents, diseases of immunodeficiency (molecules/derivatives/agonists) which stimulate the immune cell can be utilized therapeutically to enhance the immune response for conditions of inherited, acquired, infectious induced (as in HIV infection), or iatrogenic (i.e., as from chemotherapy) immunodeficiency, and neoplasia.

It has been demonstrated that some human cancer patients develop an antibody and/or immune cell response to antigens on neoplastic cells. It has also been shown in animal models of neoplasia that enhancement of the immune response can result in rejection or regression of that particular neoplasm. Molecules that enhance the immune cell response have utility in vivo in enhancing the immune response against neoplasia. Molecules which enhance the immune cell proliferative response (or small molecule agonists or antibodies that affected the same receptor in an agonistic fashion) can be used therapeutically to treat cancer. Molecules that inhibit the immune response also function in vivo during neoplasia to suppress the immune response to a neoplasm; such molecules can either be expressed by the neoplastic cells themselves or their expression can be induced by the neoplasm in other cells. Antagonism of such inhibitory molecules (either with antibody, small molecule antagonists or other means) enhances immune-mediated tumor rejection.

Additionally, inhibition of molecules with proinflammatory properties may have therapeutic benefit in reperfusion injury; stroke; myocardial infarction; atherosclerosis; acute lung injury; hemorrhagic shock; burn; sepsis/septic shock; acute tubular necrosis; endometriosis; degenerative joint disease and pancreatis.

The compounds of the present invention, e.g., polypeptides or antibodies, are administered to a mammal, preferably a human, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation (intranasal, intrapulmonary) routes. Intravenous or inhaled administration of polypeptides and antibodies is preferred.

In immunoadjuvant therapy, other therapeutic regimens, such administration of an anti-cancer agent, may be combined with the administration of the proteins, antibodies or compounds of the instant invention. For example, the patient to be treated with a the immunoadjuvant of the invention may also receive an anti-cancer agent (chemotherapeutic agent) or radiation therapy. Preparation and dosing schedules for such chemotherapeutic agents may be used according to manufacturers' instructions or as determined empirically by the skilled practitioner. Preparation and dosing schedules for such chemotherapy are also described in *Chemotherapy Service* Ed., M. C. Perry, Williams & Wilkins, Baltimore, Md. (1992). The chemotherapeutic agent may precede, or follow administration of the immunoadjuvant or may be given simultaneously therewith. Additionally, an anti-estrogen compound such as tamoxifen or an anti-progesterone such as onapristone (see, EP 616812) may be given in dosages known for such molecules.

It may be desirable to also administer antibodies against other immune disease associated or tumor associated antigens, such as antibodies which bind to CD20, CD11a, CD18, ErbB2, EGFR, ErbB3, ErbB4, or vascular endothelial factor (VEGF). Alternatively, or in addition, two or more antibodies binding the same or two or more different antigens disclosed herein may be coadministered to the patient. Sometimes, it may be beneficial to also administer one or more cytokines to the patient. In one embodiment, the PRO polypeptides are coadministered with a growth inhibitory agent. For example, the growth inhibitory agent may be administered first, followed by a PRO polypeptide. However, simultaneous administration or administration first is also contemplated. Suitable dosages for the growth inhibitory agent are those presently used and may be lowered due to the combined action (synergy) of the growth inhibitory agent and the PRO polypeptide.

For the treatment or reduction in the severity of immune related disease, the appropriate dosage of an a compound of the invention will depend on the type of disease to be treated, as defined above, the severity and course of the disease, whether the agent is administered for preventive or therapeutic purposes, previous therapy, the patient's clinical history and response to the compound, and the discretion of the attending physician. The compound is suitably administered to the patient at one time or over a series of treatments.

For example, depending on the type and severity of the disease, about 1 µg/kg to 15 mg/kg (e.g., 0.1-20 mg/kg) of polypeptide or antibody is an initial candidate dosage for administration to the patient, whether, for example, by one or more separate administrations, or by continuous infusion. A typical daily dosage might range from about 1 µg/kg to 100 mg/kg or more, depending on the factors mentioned above. For repeated administrations over several days or longer, depending on the condition, the treatment is sustained until a desired suppression of disease symptoms occurs. However, other dosage regimens may be useful. The progress of this therapy is easily monitored by conventional techniques and assays.

O. Articles of Manufacture

In another embodiment of the invention, an article of manufacture containing materials (e.g., comprising a PRO molecule) useful for the diagnosis or treatment of the disorders described above is provided. The article of manufacture comprises a container and an instruction. Suitable containers include, for example, bottles, vials, syringes, and test tubes. The containers may be formed from a variety of materials such as glass or plastic. The container holds a composition which is effective for diagnosing or treating the condition and may have a sterile access port (for example the container may be an intravenous solution bag or a vial having a stopper pierceable by a hypodermic injection needle). The active agent in the composition is usually a polypeptide or an antibody of the invention. An instruction or label on, or associated with, the container indicates that the composition is used for diagnosing or treating the condition of choice. The article of manufacture may further comprise a second container comprising a pharmaceutically-acceptable buffer, such as phosphate-buffered saline, Ringer's solution and dextrose solution. It may further include other materials desirable from a commercial and user standpoint, including other buffers, diluents, filters, needles, syringes, and package inserts with instructions for use.

P. Diagnosis and Prognosis of Immune Related Disease

Cell surface proteins, such as proteins which are overexpressed in certain immune related diseases, are excellent targets for drug candidates or disease treatment. The same proteins along with secreted proteins encoded by the genes amplified in immune related disease states find additional use in the diagnosis and prognosis of these diseases. For example, antibodies directed against the protein products of genes amplified in rheumatoid arthritis, or another immune related disease, can be used as diagnostics or prognostics.

For example, antibodies, including antibody fragments, can be used to qualitatively or quantitatively detect the expression of proteins encoded by amplified or overexpressed genes ("marker gene products"). The antibody preferably is equipped with a detectable, e.g., fluorescent label, and binding can be monitored by light microscopy, flow cytometry, fluorimetry, or other techniques known in the art. These techniques are particularly suitable, if the overexpressed gene encodes a cell surface protein Such binding assays are performed essentially as described above.

In situ detection of antibody binding to the marker gene products can be performed, for example, by immunofluorescence or immunoelectron microscopy. For this purpose, a histological specimen is removed from the patient, and a labeled antibody is applied to it, preferably by overlaying the antibody on a biological sample. This procedure also allows for determining the distribution of the marker gene product in the tissue examined. It will be apparent for those skilled in the art that a wide variety of histological methods are readily available for in situ detection.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Manassas, Va.

Example 1

Microarray Analysis of Systemic Lupus Erythematosis (SLE)

Nucleic acid microarrays, often containing thousands of gene sequences, are useful for identifying differentially expressed genes in diseased tissues as compared to their normal counterparts. Using nucleic acid microarrays, test and control mRNA samples from test and control tissue samples are reverse transcribed and labeled to generate cDNA probes. The cDNA probes are then hybridized to an array of nucleic acids immobilized on a solid support. The array is configured such that the sequence and position of each member of the array is known. For example, a selection of genes known to be expressed in certain disease states may be arrayed on a solid support. Hybridization of a labeled probe with a particular array member indicates that the sample from which the probe was derived expresses that gene. If the hybridization signal of a probe from a test (in this instance, Peripheral Blood Mononuclear cells (PBMC) taken from whole blood of SLE patients) sample is greater than hybridization signal of a probe from a control (in this instance, normal PBMC) sample, the gene or genes overexpressed in the test tissue are identified. The implication of this result is that an overexpressed protein in a test tissue is useful not only as a diagnostic marker for the presence of the disease condition, but also as a therapeutic target for treatment of the disease condition.

The methodology of hybridization of nucleic acids and microarray technology is well known in the art. In one example, the specific preparation of nucleic acids for hybridization and probes, slides, and hybridization conditions are all detailed in PCT Patent Application Serial No. PCT/US01/10482, filed on Mar. 30, 2001 and which is herein incorporated by reference.

A proprietary database containing gene expression information (GeneExpress®, Gene Logic Inc., Gaithersburg, Md.) was analyzed in an attempt to identify polypeptides (and their encoding nucleic acids) whose expression is significantly upregulated in SLE as compared to normal tissues. Specifically, analysis of the GeneExpress® database was conducted using either software available through Gene Logic Inc., Gaithersburg, Md., for use with the GeneExpress® database or with proprietary software written and developed at Genentech, Inc. for use with the GeneExpress® database. The rating of positive hits in the analysis is based upon several criteria including, for example; expression level, tissue specificity, and expression level in normal essential and/or normal proliferating tissues. The following is a list of molecules whose tissue expression profile as determined from an analysis of the GeneExpress® database evidences high tissue expression and significant upregulation of expression in PBMC from SLE patients as compared to normal PBMC taken from twenty-five healthy individuals and optionally relatively low expression in normal essential and/or normal proliferating tissues. As such, the molecules listed below are excellent polypeptide targets for the diagnosis and therapy for SLE in mammals.

The results of these experiments, are that FIGS. 1-596 are PRO polypeptides of the present invention significantly overexpressed in PBMC isolated from patients with SLE as compared to normal PBMC.

Example 2

Use of PRO as a Hybridization Probe

The following method describes use of a nucleotide sequence encoding PRO as a hybridization probe.

DNA comprising the coding sequence of full-length or mature PRO as disclosed herein is employed as a probe to screen for homologous DNAs (such as those encoding naturally-occurring variants of PRO) in human tissue cDNA libraries or human tissue genomic libraries.

Hybridization and washing of filters containing either library DNAs is performed under the following high stringency conditions. Hybridization of radiolabeled PRO-derived probe to the filters is performed in a solution of 50% formamide, 5×SSC, 0.1% SDS, 0.1% sodium pyrophosphate, 50 mM sodium phosphate, pH 6.8, 2× Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence PRO can then be identified using standard techniques known in the art.

Example 3

Expression of PRO in *E. coli*

This example illustrates preparation of an unglycosylated form of PRO by recombinant expression in *E. coli*.

The DNA sequence encoding PRO is initially amplified using selected PCR primers. The primers should contain restriction enzyme sites which correspond to the restriction enzyme sites on the selected expression vector. A variety of expression vectors may be employed. An example of a suitable vector is pBR322 (derived from *E. coli*; see Bolivar et al., *Gene*, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the PRO coding region, lambda transcriptional terminator, and an argU gene.

The ligation mixture is then used to transform a selected *E. coli* strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized PRO protein can then be purified using a metal chelating column under conditions that allow tight binding of the protein.

PRO may be expressed in E. coli in a poly-His tagged form, using the following procedure. The DNA encoding PRO is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an E. coli host based on strain 52 (W3110 fuhA(tonA) lon galE rpoHts(htpRts) clpP(lacIq). Transformants are first grown in LB containing 50 mg/ml carbenicillin at 30° C. with shaking until an O.D. 600 of 3-5 is reached. Cultures are then diluted 50-100 fold into CRAP media (prepared by mixing 3.57 g $(NH_4)_2SO_4$, 0.71 g sodium citrate.2H2O, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20-30 hours at 30° C. with shaking. Samples are removed to verify expression by SDS-PAGE analysis, and the bulk culture is centrifuged to pellet the cells. Cell pellets are frozen until purification and refolding.

E. coli paste from 0.5 to 1 L fermentations (6-10 g pellets) is resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution is stirred overnight at 4° C. This step results in a denatured protein with all cysteine residues blocked by sulfitolization. The solution is centrifuged at 40,000 rpm in a Beckman Ultracentifuge for 30 min. The supernatant is diluted with 3-5 volumes of metal chelate column buffer (6 M guanidine, 20 mM Tris, pH 7.4) and filtered through 0.22 micron filters to clarify. The clarified extract is loaded onto a 5 ml Qiagen Ni-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 nm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/ml. The refolding solution is stirred gently at 4° C. for 12-36 hours. The refolding reaction is quenched by the addition of TFA to a final concentration of 0.4% (pH of approximately 3). Before further purification of the protein, the solution is filtered through a 0.22 micron filter and acetonitrile is added to 2-10% final concentration. The refolded protein is chromatographed on a Poros R1/H reversed phase column using a mobile buffer of 0.1% TFA with elution with a gradient of acetonitrile from 10 to 80%. Aliquots of fractions with A280 absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded PRO polypeptide are pooled and the acetonitrile removed using a gentle stream of nitrogen directed at the solution. Proteins are formulated into 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Many of the PRO polypeptides disclosed herein were successfully expressed as described above.

Example 4

Expression of PRO in Mammalian Cells

This example illustrates preparation of a potentially glycosylated form of PRO by recombinant expression in mammalian cells.

The vector, pRK5 (see EP 307,247, published Mar. 15, 1989), is employed as the expression vector. Optionally, the PRO DNA is ligated into pRK5 with selected restriction enzymes to allow insertion of the PRO DNA using ligation methods such as described in Sambrook et al., supra. The resulting vector is called pRK5-PRO.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg pRK5-PRO DNA is mixed with about 1 μg DNA encoding the VA RNA gene [Thimmappaya et al., *Cell*, 31:543 (1982)] and dissolved in 500 μl of 1 mM Tris-HCl, 0.1 mM EDTA, 0.227 M $CaCl_2$. To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}$S-cysteine and 200 μCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of PRO polypeptide. The cultures containing transfected cells may undergo further incubation (in serum free medium) and the medium is tested in selected bioassays.

In an alternative technique, PRO may be introduced into 293 cells transiently using the dextran sulfate method described by Somparyrac et al., *Proc. Natl. Acad. Sci.*, 12:7575 (1981). 293 cells are grown to maximal density in a spinner flask and 700 μg pRK5-PRO DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 µg/ml bovine insulin and 0.1 µg/ml bovine transferrin. After about four days, the conditioned media is centrifuged and filtered to remove cells and debris. The sample containing expressed PRO can then be concentrated and purified by any selected method, such as dialysis and/or column chromatography.

In another embodiment, PRO can be expressed in CHO cells. The pRK5-PRO can be transfected into CHO cells using known reagents such as $CaPO_4$ or DEAE-dextran. As described above, the cell cultures can be incubated, and the medium replaced with culture medium (alone) or medium containing a radiolabel such as $^{35}S$-methionine. After determining the presence of PRO polypeptide, the culture medium may be replaced with serum free medium. Preferably, the cultures are incubated for about 6 days, and then the conditioned medium is harvested. The medium containing the expressed PRO can then be concentrated and purified by any selected method.

Epitope-tagged PRO may also be expressed in host CHO cells. The PRO may be subcloned out of the pRK5 vector. The subclone insert can undergo PCR to fuse in frame with a selected epitope tag such as a poly-his tag into a Baculovirus expression vector. The poly-his tagged PRO insert can then be subcloned into a SV40 promoter/enhancer containing vector containing a selection marker such as DHFR for selection of stable clones. Finally, the CHO cells can be transfected (as described above) with the SV40 promoter/enhancer containing vector. Labeling may be performed, as described above, to verify expression. The culture medium containing the expressed poly-His tagged PRO can then be concentrated and purified by any selected method, such as by $Ni^{2+}$-chelate affinity chromatography.

PRO may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g. extracellular domains) of the respective proteins are fused to an IgG1 constant region sequence containing the hinge, CH2 and CH2 domains and/or is a poly-His tagged form.

Following PCR amplification, the respective DNAs are subcloned in a CHO expression vector using standard techniques as described in Ausubel et al., *Current Protocols of Molecular Biology*, Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24:9 (1774-1779 (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA is introduced into approximately 10 million CHO cells using commercially available transfection reagents Superfect® (Quiagen), Dosper® or Fugene® (Boehringer Mannheim). The cells are grown as described in Lucas et al., supra. Approximately $3 \times 10^{-7}$ cells are frozen in an ampule for further growth and production as described below.

The ampules containing the plasmid DNA are thawed by placement into water bath and mixed by vortexing. The contents are pipetted into a centrifuge tube containing 10 mL of media and centrifuged at 1000 rpm for 5 minutes. The supernatant is aspirated and the cells are resuspended in 10 mL of selective media (0.2 µm filtered PS20 with 5% 0.2 µm diafiltered fetal bovine serum). The cells are then aliquoted into a 100 mL spinner containing 90 mL of selective media. After 1-2 days, the cells are transferred into a 250 mL spinner filled with 150 mL selective growth medium and incubated at 37° C. After another 2-3 days, 250 mL, 500 mL and 2000 mL spinners are seeded with $3 \times 10^5$ cells/mL. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3 L production spinner is seeded at $1.2 \times 10^6$ cells/mL. On day 0, pH is determined. On day 1, the spinner is sampled and sparging with filtered air is commenced. On day 2, the spinner is sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability dropped below 70%, the cell culture is harvested by centrifugation and filtering through a 0.22 µm filter. The filtrate was either stored at 4° C. or immediately loaded onto columns for purification.

For the poly-His tagged constructs, the proteins are purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4-5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at -80° C.

Immunoadhesin (Fc-containing) constructs are purified from the conditioned media as follows. The conditioned medium is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 µl of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Many of the PRO polypeptides disclosed herein were successfully expressed as described above.

Example 5

Expression of PRO in Yeast

The following method describes recombinant expression of PRO in yeast.

First, yeast expression vectors are constructed for intracellular production or secretion of PRO from the ADH2/GAPDH promoter. DNA encoding PRO and the promoter is inserted into suitable restriction enzyme sites in the selected plasmid to direct intracellular expression of PRO. For secretion, DNA encoding PRO can be cloned into the selected plasmid, together with DNA encoding the ADH2/GAPDH promoter, a native PRO signal peptide or other mammalian signal peptide, or, for example, a yeast alpha-factor or invertase secretory signal/leader sequence, and linker sequences (if needed) for expression of PRO.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant PRO can subsequently be isolated and purified by removing the yeast cells from the fermentation medium by centrifugation and then concentrating the medium using selected cartridge filters. The concentrate containing PRO may further be purified using selected column chromatography resins.

Many of the PRO polypeptides disclosed herein were successfully expressed as described above.

Example 6

Expression of PRO in Baculovirus-Infected Insect Cells

The following method describes recombinant expression of PRO in Baculovirus-infected insect cells.

The sequence coding for PRO is fused upstream of an epitope tag contained within a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the sequence encoding PRO or the desired portion of the coding sequence of PRO such as the sequence encoding the extracellular domain of a transmembrane protein or the sequence encoding the mature protein if the protein is extracellular is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4-5 days of incubation at 28° C., the released viruses are harvested and used for further amplifications. Viral infection and protein expression are performed as described by O'Reilley et al., *Baculovirus expression vectors: A Laboratory Manual*, Oxford: Oxford University Press (1994).

Expressed poly-his tagged PRO can then be purified, for example, by $Ni^{2+}$-chelate affinity chromatography as follows. Extracts are prepared from recombinant virus-infected Sf9 cells as described by Rupert et al., *Nature*, 362:175-179 (1993). Briefly, Sf9 cells are washed, resuspended in sonication buffer (25 mL Hepes, pH 7.9; 12.5 mM $MgCa_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 μl filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or Western blot with $Ni^{2+}$-NTA-conjugated to alkaline phosphatase (Qiagen). Fractions containing the eluted $His_{10}$-tagged PRO are pooled and dialyzed against loading buffer.

Alternatively, purification of the IgG tagged (or Fc tagged) PRO can be performed using known chromatography techniques, including for instance, Protein A or protein G column chromatography.

Many of the PRO polypeptides disclosed herein were successfully expressed as described above.

Example 7

Preparation of Antibodies that Bind PRO

This example illustrates preparation of monoclonal antibodies which can specifically bind PRO.

Techniques for producing the monoclonal antibodies are known in the art and are described, for instance, in Goding, supra. Immunogens that may be employed include purified PRO, fusion proteins containing PRO, and cells expressing recombinant PRO on the cell surface. Selection of the immunogen can be made by the skilled artisan without undue experimentation.

Mice, such as Balb/c, are immunized with the PRO immunogen emulsified in complete Freund's adjuvant and injected subcutaneously or intraperitoneally in an amount from 1-100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retroorbital bleeding for testing in ELISA assays to detect anti-PRO antibodies.

After a suitable antibody titer has been detected, the animals "positive" for antibodies can be injected with a final intravenous injection of PRO. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against PRO. Determination of "positive" hybridoma cells secreting the desired monoclonal antibodies against PRO is within the skill in the art.

The positive hybridoma cells can be injected intraperitoneally into syngeneic Balb/c mice to produce ascites containing the anti-PRO monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Example 8

Purification of PRO Polypeptides Using Specific Antibodies

Native or recombinant PRO polypeptides may be purified by a variety of standard techniques in the art of protein purification. For example, pro-PRO polypeptide, mature PRO polypeptide, or pre-PRO polypeptide is purified by immunoaffinity chromatography using antibodies specific for the PRO polypeptide of interest. In general, an immunoaffinity column is constructed by covalently coupling the anti-PRO polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of PRO polypeptide by preparing a fraction from cells containing PRO polypeptide in a soluble form. This preparation is derived by solubilization of the whole cell or of a subcellular fraction obtained via differential centrifugation by the addition of detergent or by other methods well known in the art. Alternatively, soluble PRO polypeptide containing a signal sequence may be secreted in useful quantity into the medium in which the cells are grown.

A soluble PRO polypeptide-containing preparation is passed over the immunoaffinity column, and the column is washed under conditions that allow the preferential absorbance of PRO polypeptide (e.g., high ionic strength buffers in the presence of detergent). Then, the column is eluted under conditions that disrupt antibody/PRO polypeptide binding (e.g., a low pH buffer such as approximately pH 2-3, or a high concentration of a chaotrope such as urea or thiocyanate ion), and PRO polypeptide is collected.

Example 9

Drug Screening

This invention is particularly useful for screening compounds by using PRO polypeptides or binding fragment thereof in any of a variety of drug screening techniques. The PRO polypeptide or fragment employed in such a test may either be free in solution, affixed to a solid support, borne on a cell surface, or located intracellularly. One method of drug screening utilizes eukaryotic or prokaryotic host cells which are stably transformed with recombinant nucleic acids expressing the PRO polypeptide or fragment. Drugs are screened against such transformed cells in competitive binding assays. Such cells, either in viable or fixed form, can be used for standard binding assays. One may measure, for example, the formation of complexes between PRO polypeptide or a fragment and the agent being tested. Alternatively, one can examine the diminution in complex formation between the PRO polypeptide and its target cell or target receptors caused by the agent being tested.

Thus, the present invention provides methods of screening for drugs or any other agents which can affect a PRO polypeptide-associated disease or disorder. These methods comprise contacting such an agent with an PRO polypeptide or fragment thereof and assaying (I) for the presence of a complex between the agent and the PRO polypeptide or fragment, or (ii) for the presence of a complex between the PRO polypeptide or fragment and the cell, by methods well known in the art. In such competitive binding assays, the PRO polypeptide or fragment is typically labeled. After suitable incubation, free PRO polypeptide or fragment is separated from that present in bound form, and the amount of free or uncomplexed label is a measure of the ability of the particular agent to bind to PRO polypeptide or to interfere with the PRO polypeptide/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to a PRO polypeptide, the peptide test compounds are reacted with PRO polypeptide and washed. Bound PRO polypeptide is detected by methods well known in the art. Purified PRO polypeptide can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding PRO polypeptide specifically compete with a test compound for binding to PRO polypeptide or fragments thereof. In this manner, the antibodies can be used to detect the presence of any peptide which shares one or more antigenic determinants with PRO polypeptide.

Example 10

Rational Drug Design

The goal of rational drug design is to produce structural analogs of biologically active polypeptide of interest (i.e., a PRO polypeptide) or of small molecules with which they interact, e.g., agonists, antagonists, or inhibitors. Any of these examples can be used to fashion drugs which are more active or stable forms of the PRO polypeptide or which enhance or interfere with the function of the PRO polypeptide in vivo (cf., Hodgson, *Bio/Technology*, 9: 19-21 (1991)).

In one approach, the three-dimensional structure of the PRO polypeptide, or of a PRO polypeptide-inhibitor complex, is determined by x-ray crystallography, by computer modeling or, most typically, by a combination of the two approaches. Both the shape and charges of the PRO polypeptide must be ascertained to elucidate the structure and to determine active site(s) of the molecule. Less often, useful information regarding the structure of the PRO polypeptide may be gained by modeling based on the structure of homologous proteins. In both cases, relevant structural information is used to design analogous PRO polypeptide-like molecules or to identify efficient inhibitors. Useful examples of rational drug design may include molecules which have improved activity or stability as shown by Braxton and Wells, *Biochemistry*, 31:7796-7801 (1992) or which act as inhibitors, agonists, or antagonists of native peptides as shown by Athauda et al., *J. Biochem.*, 113:742-746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the PRO polypeptide may be made available to perform such analytical studies as X-ray crystallography. In addition, knowledge of the PRO polypeptide amino acid sequence provided herein will provide guidance to those employing computer modeling techniques in place of or in addition to x-ray crystallography.

The foregoing written specification is considered to be sufficient to enable one skilled in the art to practice the invention. The present invention is not to be limited in scope by the construct deposited, since the deposited embodiment is intended as a single illustration of certain aspects of the invention and any constructs that are functionally equivalent are within the scope of this invention. The deposit of material herein does not constitute an admission that the written description herein contained is inadequate to enable the practice of any aspect of the invention, including the best mode thereof, nor is it to be construed as limiting the scope of the claims to the specific illustrations that it represents. Indeed, various modifications of the invention in addition to those shown and described herein will become apparent to those skilled in the art from the foregoing description and fall within the scope of the appended claims.

---

SEQUENCE LISTING (596 sequences)

SEQ ID NO: 1 - DNA, 2853 bp, Homo sapiens
gctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcgctttcaagataaattctgtcattaatcgtttcaacgtggaagaggacatgacggaacagatcaaagcactaaaccctgtccgctggaaagtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaaaatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgcttttttttttttgcctttatgccattgcagtcttgtactttttactgtgatgtacagaaatagtcaacagatgtttccaagaacatatgatatgataatcctaccaattttcaagaagtctctagaaagagataacacatggaaagacggcgtggtgcagcccagcccacggtgcctgttccatgaatgctggctacctatgtgtgtggtacctgttgtgtccctttctcttcaaagatccctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatttctgagaagtgacgttacactgggttggcataagatatcctaaaatcacgctggaaccttgggcaaggaagaatgtgagcaagagtagagagagtgcctggatttcatgtcagtgaagccatgtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttaaaaaaaaaaaaaaaaaaaaaaaaaaaaaaaaggccaaggaaaaaaaatattcctacttaaattttaagtctataattcaatttaaatatgtgtgtgtctcatccaggataggataggttgtcttctattttccattttacctatttactttttttgtaagaaaagagaagaatgaattctaaagatgttccccatgggttttgattgtgtctaagctatgatgaccttcatataatcagcataaacataaaacaaattttttacttaacatgagtgcactttactaatcctcatggcacagtggctcacgcctgtaatcccagcacttggggaggacaatgtggggtggatcacgaggtc

SEQ ID NO: 2 - protein, 361 aa, Homo sapiens
MWVLTPAAFAGKLLSVFRQPLSSLWRSLVPLFCWLRATFWLLATKRRKQQLVLRGPDETKEEEEDPPLPTTPTSVNYHFTRQCNYKCGFCFHTAKTSFVLPLEEAKRGLLLLKEAGMEKINFSGGEPFLQDRGEYLGKLVRFCKVELRLPSVSIVSNGSLIRERWFQNYGEYLDILAISCDSFDEEVNVLIGRGQGKKNHVENLQKLRRWCRDYRVAFKINSVINRFNVEEDMTEQIKALNPVRWKVFQCLLIEGENCGEDALREAERFVIGDEEFERFLERHKEVSCLVPESNQKMKDSYLILDEYMRFLNCRKGRKDPSKSILDVGVEEAIKFSGFDEKMFLKRGGKYIWSKADLKLDW

SEQ ID NO: 3 - DNA, 3200 bp, Homo sapiens
caggaagggccatgaagattaataaagatttggactcagggcaaatatttacttagtagcaataactcaaagaattactgttgaataaataagccaattaagcagccaatcacgtactatgcggatgcacacaaatgaaaccctcacttcaacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggctgagcgcgatgactcacgcctgtaagcctagaactttgggaggccaaagcaggcagactgcttgagcccaggagttccagaccagcctgggcaacatggcaacaccccatctctacaaaaaaatacaagaatcagctgggcgtggtgatgtgttcctgtaatctcagctactcgggaggcagaggcaggaggattgcttgaacccgggaggcagaggttgtagttagccgagatctcgccactgcactccagtctggacgacagagtgagactcagtctcaaataaataaataaatacataaatataaggaaaaaaataaagctgctttctcctcttcctcctctttggtctcatctggctctgctccaggcatctgccacaatgtgggtgcttacacctgctgcttttgctgggaagttcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagaatccctttcaagataaattctgtcattaatcgtttcaacgtggaagaggacatgacggaacagatcaaagcactaaaccctgtccgctggaaagtgttccagtgcctcttaattgaaggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaatatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgcttttttttttttttgcttttatgccattgcagtcttgtactttttactgtgatgtacagaaatagtcaacagatgtttccaagaacatatgatatgataatcctaccaattttcaagaagtctctagaaagagataacacatggaaagacggcgtggtgcagcccagcccacggtgcctgttccatgaatgctggctacctatgtgtgtggtacctgttgtgtccctttctcttcaaagatccctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatttctgagaagtgacgttacactgggttggcataagatatcctaaaatcacgctggaaccttgggcaaggaagaatgtgagcaagagtagagagagtgcctggatttcatgtcagtgaagccatgtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttaaaaaaaaaaaaaaaaaaaaaaaaaaaaaaaaggcca

SEQ ID NO: 4 - protein, 361 aa, Homo sapiens
MWVLTPAAFAGKFLSVFRQPLSSLWRSLVPLFCWLRATFWLLATKRRKQQLVLRGPDETKEEEEDPPLPTTPTSVNYHFTRQCNYKCGFCFHTAKTSFVLPLEEAKRGLLLLKEAGMEKINFSGGEPFLQDRGEYLGKLVRFCKVELRLPSVSIVSNGSLIRERWFQNYGEYLDILAISCDSFDEEVNVLIGRGQGKKNHVENLQKLRRWCRDYRIPFKINSVINRFNVEEDMTEQIKALNPVRWKVFQCLLIEGENCGEDALREAERFVIGDEEFERFLERHKEVSCLVPESNQKMKDSYLILDEYMRFLNCRKGRKDPSKSILDVGVEEAIKFSGFDEKMFLKRGGKYIWSKADLKLDW

SEQ ID NO: 5 - DNA, 2058 bp, Homo sapiens
gcacgaggaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaactgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgataccaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgc

SEQ ID NO: 6 - protein, 413 aa, Homo sapiens
MVERCSRQGCTITMAYIDYNMIVAFMLGNYINLRESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDTTSITERYRIYSVKDGKNGKSLPFMLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALQPCI

SEQ ID NO: 7 - DNA, 2498 bp, Homo sapiens
cttttattacagttaaatggttccagatgtaaccactagttttaaaggtatttgctcattggtctggcttagagacaggaagacatatgagccataaaaaaaagattcttttgcatttacccatttagtaaaaacttattaaaactgaataaagtgctgttcttaagtgcttgaaagacgtaaacccaagtgcactttatctcatttatcttatggtggaaacacaggaaccaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttg

SEQ ID NO: 8 - protein, 32 aa, Homo sapiens
MGDHQKVILSHLDVTIETNWGVGCYCKIKYTV

SEQ ID NO: 9 - DNA, 2506 bp, Homo sapiens
catctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaacaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctggaagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtggtcactccccttccaccctcagcggatgataatctcaagacacctcctgagtgtctgctcactccccttccaccctcagcggatgataatctcaagacacctcccgagtgtctactcactccccg

SEQ ID NO: 10 - protein, 166 aa, Homo sapiens
MFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVVTPLPPSADDNLKTPPECLLTPLPPSADDNLKTPPECLLTP

SEQ ID NO: 11 - DNA, 5130 bp, Homo sapiens
atgggcttcttgcccaagcttctcctcctggcctcattcttcccagcaggccaggcctcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgcaccgagttcatggggaaccccgagcacagggtgtgcaacctgctgctgaaggacctgcagcccgaggactctggttcctacaacttccgcttcgagatcagtgaggtcaaccgctggtcagatgtgaaaggcaccttggtcacagtaacagaggagcccagggtgcccaccattgcctccccggtggagcttctcgagggcacagaggtggacttcaactgctccactccctacgtatgcctgcaggagcaggtcagactgcagtggcaaggccaggaccctgctcgctctgtcaccttcaacagccagaagtttgagcccaccggcgtcggccacctggagaccctccacatggccatgtcctggcaggaccacggccggatcctgcgctgccagctctccgtggccaatcacagggctcagagcgagattcacctccaagtgaagtatgcccccaagggtgtgaagatcctcctcagcccctcggggaggaacatccttccaggtgagctggtcacactcacctgccaggtgaacagcagctaccctgcagtcagttccattaagtggctcaaggatggggtacgcctccaaaccaagactggtgtgctgcacctgccccaggcagcctggagcgatgctggcgtctacacctgccaagctgagaacggcgtgggctctttggtctcaccccccatcagcctccacatcttcatggctgaggtccaggtgagcccagcaggtcccatcctggagaaccagacagtgacactagtctgcaacacacccaatgaggcacccagtgatctccgctacagctggtacaagaaccatgtcctgctggaggatgcccactcccataccctccggctgcacttggccactagggctgatactggcttctacttctgtgaggtgcagaacgtccatggcagcgagcgctcgggccctgtcagcgtggtagtcaaccacccgcctctcactccagtcctgacagccttcctggagacccaggcgggacttgtgggcatccttcactgctctgtggtcagtgagcccctggccacactggtgctgtcacatgggggtcatatcctggcctccacctccggggacagtgatcacagcccacgcttcagtggtacctctggtcccaactccctgcgcctggagatccgagacctggaggaaactgacagtggggagtacaagtgctcagccaccaactcccttggaaatgcaacctccaccctggacttccatgccaatgccgcccgtctcctcatcagcccggcagccgaggtggtggaaggacaggcagtgacactgagctgcagaagcggcctaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctacccccctcgacaaccaacattcaccaccaggctggaccttgatgccgctggggccggggctggacggcgaggcctccttttgtgccgtgtggacagcgacccccccgccaggctgcagctgctccacaaggaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaacgcctccacctcagccaccttcaatggccaggccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtactctatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaaagctgaggccaactccctgaagttagaggtccgagaactgggccttggggactctggcagctaccgctgtgaggccacaaatgttcttggatcatccaacacctcactcttcttccaggtccgaggagcctgggtccaggtgtcaccatcacctgagctccaagagggccaggctgtggtcctgagctgccaggtacacacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgcacccatcagcctccacgtgtcctatgccccacgccacgtcacactcactaccctgatggacacaggccctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaagctgtgaatgtgcaggtgtggcccggggctaccgtgcgggaggggcagctggtgaacctgacctgccttgtgtggaccactcacccggcccagctcacctacacatggtaccaggatgggcagcagcgcctggatgcccactccatccccctgcccaacgtcacagtcagggatgccacctcctaccgctgcggtgtgggcccccctggtcgggcaccccgcctctccagacctatcaccttggacgtcctctacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagagccctgcaccgcctgcatcagttccagcagctgctctgggtcctgggactgctggtgggcctcctgctcctgctgttgggcctgggggcctgctacacctggagaaggaggcgtgtttgtaagcagagcatgggcgagaattcggtggagatggcttttcagaaagagaccacgcagctcattgatcctgatgcagccacatgtgagacctcaacctgtgccccacccctgggctga

SEQ ID NO: 12 - protein, 1709 aa, Homo sapiens
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWRRRRVCKQSMGENSVEMAFQKETTQLIDPDAATCETSTCAPPLG

SEQ ID NO: 13 - DNA, 1720 bp, Homo sapiens
gagaagaccagggaagaagcagaacttgaggccaacagtgtgtttcgtcaaaaggtagaaatgtcctaccagcggatggagaatcctggctgccatgtggttgatgccagcccctccagagaaaaggtcctgcagacggtattaagcctaatccagaatagttttagtgaaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctgtataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaaaaaaaaaaaaaaa

SEQ ID NO: 14 - DNA, 634 bp, Homo sapiens
cggctgagaggcagcgaactcatctttgccagtacaggagcttgtgccgtggcccacagcccacagcccacagccatgggctgggacctgacggtgaagatgctggcgggcaacgaattccaggtgtccctgagcagctccatgtcggtgtcagagctgaaggcgcagatcacccagaagattggcgtgcacgccttccagcagcgtctggctgtccacccgagcggtgtggcgctgcaggacagggtcccccttgccagccagggcctgggccctggcagcacggtcctgctggtggtggacaaatgcgacgaacctctgagcatcctggtgaggaataacaagggccgcagcagcacctacgaggtccggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaagagaat

SEQ ID NO: 15 - protein, 165 aa, Homo sapiens
MGWDLTVKMLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 16 - DNA, 1642 bp, Homo sapiens
ccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaagaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttctactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctataaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatatt

SEQ ID NO: 17 - protein, 478 aa, Homo sapiens
MSTNGDDHQVKDSLEQLRCHFTWELSIDDDEMPDLENRVLDQIEFLDTKYSVGIHNLLAYVKHLKGQNEEALKSLKEAENLMQEEHDNQANVRSLVTWGNFAWMYYHMGRLAEAQTYLDKVENICKKLSNPFRYRMECPEIDCEEGWALLKCGGKNYERAKACFEKVLEVDPENPESSAGYAISAYRLDGFKLATKNHKPFSLLPLRQAVRLNPDNGYIKVLLALKLQDEGQEAEGEKYIEEALANMSSQTYVFRYAAKFYRRKGSVDKALELLKKALQETPTSVLLHHQIGLCYKAQMIQIKEATKGQPRGQNREKLDKMIRSAIFHFESAVEKKPTFEVAHLDLARMYIEAGNHRKAEENFQKLLCMKPVVEETMQDIHFYYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 18 - DNA, 4579 bp, Homo sapiens
gctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaagtatgtatagtcattcatttaacattcagaatgcttctctctttttacaattggtttgttttggtgtgaagtatttttattttctcatttatatagactcaccaaatctcatcaaggttttttgttttttttagttttgattatacctttaaaaatattctactattaacacttctaagtttgtttctctacgttagtaacagaactcatgacatgatggtagatcctggatttctgttggcttgaacaactttacacttattgccaataaacctccttgagggtagggaccacatcttactcgtttttgtgctctctgtacttaatgcgtacataacatgtttaattgatgtacagtaaatataaatgctgccatttaaagttatagcattatcctttagaggtggaagagaactaaagttcatttagttcacaaagaaattgtaggcttgctcaagtccagctgtggggctatgctgaaattcgatggtctcctttattacatgattggtaggaaatttaacttcatgactaatgatggacagaaaggcacaaaagggaaaaagctctctaaagagtctccaccggacatgtagctccgggtgggacagcgggtcagtgcagaatatgacaatcacagccatgcagggactatgggaactgccagcagttctggtatcttacaagcttttgatttaaatacttaataggagattaagtctcaatgtggtctggatttcgaaatgtttcagaatttgtttttctagtaatggacatttgaaacaggtctcatgaggagataaggggaggcgctggagtgacagaactaatttctctctggcgccccctgctgtcgtgcagagtgaacatttaggaaatgagccctgctccccaggaagccgactctgcacagtggtctggagtgcctgaaaccagagcaagggtctccacctgtagcaccgagccctcattccctagagtcgcagtaagcttgggagcattgaagataaagcgagtatgggcatcagaattctctggggatatgtttacctatgtgtggaaagttcttattgacgtgaaaatattctagttttgcacacattttctataggtaactttaaaaattaacttgatatagagttttaaaaatgccagaatggtaggaaaatctatacttcttttagtaggagcccaggtggtttttcaaattcgaaccctctgtgctgactcttggtgagaatgtgccacagggccgggcccaggatgacctgtacgggtcagggctgaatattgtgtttctaacctggaagccttgttcactcatgctcacatatagttaattgccttctaatagttgtttcttatgctttgaagggactggttttcttttagaagtctaataattgacgatttgatatttctcgcctggcttagttgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatggaaacttcctatcctgcctagggatcacagctgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaaactctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtataaatgggtcatttttatttttaatgaaaagttattggggttttctctcttgaagggtctcattttaattcccttttccaggccgtatagatcaaatatagtactgtcattactgttggctcttgttttggtcttgacttactaatagtgttaccctgattttcagagggggacagtttatctccagaaaggccaatgtttgtatacacatcagctagacacaaatatagacatcatatgtagtttgtacatgtttcagaaacttgttttttctttgctctgtgtaacctatttcctattgctagttcagttggctttcttattcacttctgtgaccctgaaccagttctcagaccctagagtgtaagagcattgattttctacgctgtgtaatctagctcaatccctctgtcccctccgcctcaccgtcccccagccaccacattgtatagcaaaagcattacattcaatcctagaataaaggtaaatacaacaaatcatctttgcagctggacaactaataatactttgcagcattaagagatcttctgtgttaccagtcactctgttgaaatgaactttccgaatctctttattcaggaaaacatggggttttgaaattcttgggccaagagacataactgaggggttcgcagagctaggcaagggtgcactaggaaagggccacattggtgggtggggggtaacagagaacagatggtgtcaggaagtttctctggagtaaataatgtggatattcttggtttccctctcctccgccagctgaagctgtgttagtgctgttgacactaatataaaatgtttggtccatttgaaatccttgtcattgccttatatgggggaaactcaatcccccagcctgtgttggaaatatcaccaaactgattgtaaatgtgcggctgtagcagacattttagtgtggtggtgtgcagccatttcggccctacacctgccagcctggctaccttacagttgtgttccgatttttgcgtctatgcttggtgtgcctcacttgctgcattttccagcatgcaaccaggagttgacgtaggaaaaagggatgctttcttactttggaagctctcagggaagttggtgtcaatttctcctccactgcctggcctaccctgcactcccaaagattttgtgcagatgggtagttccattttttaaaaattgtgcagatatggaaaattgtgacttacttcatgaccagaactatctagaatatgtgtgggggtataaacatcttgcttaaccaaatatctatgtaggcagaggtaaccaggagagaagcaagacttgctgcctaaaggagcccaccattttacttttcacatttaatctgccacgttgaatcaattggaataaaacctgactcgcaggtgactggacaggaaatcccaaagttccaccatttctatgcttaattttaacgtccccccgctttttttttgtagaaaataaaaacaagaaaatcgttccaatgtaagatgtttgttatagaaactttaggcaatacaggtgtgtaataaaatgtttaataaacttctaaacacttttgtatttggatttaaaaaaaaaaaaaaaaaaaa

SEQ ID NO: 19 - protein, 191 aa, Homo sapiens [sequence omitted]

SEQ ID NO: 20 - DNA, 2787 bp, Homo sapiens
agagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcag

SEQ ID NO: 21 - protein, 662 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKINAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 22 - DNA, 2840 bp, Homo sapiens
cggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtttgtatgaaaagaaactgttaaacctaactgtccgaattgacatcatgggagaaggatacatttcttacactgaactggacttcgagctgataaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatatactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagcatattgactttgctgtggatgagaatggattgtgggttatttattcaactgaagccagcactggttaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcagatatctaagtaagtggagaagactattttttcaacaaacattttctctttcaccctaactcctaaacagcttactggggcttctgcaagacagaaagatcataattcagaaggtaaccatcgttatagacataaagtttctggtcaaaagggttatagttaatgctctgcactttttcctgcatcttatgcattacaatgtctagtttgccctctttccctgtgtttgtgtcataatagtaaaaaatctcttctgtttggcgtatagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgcttcgaaaaaaaaaaaaaaaaaaaaaaaaaaaaaaa

SEQ ID NO: 23 - protein, 218 aa, Homo sapiens
MEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYILYNTLDDLLLYINARELRITYGQGSGTAVYNNNMYVNMYNTGNIARVNLTTNTIAVTQTLPNAAYNNRFSYANVAWQAY

SEQ ID NO: 24 - DNA, 1919 bp, Homo sapiens
ctgaagaacaaatcagcctggtcaccagcttttcggaacagcagagacacagagggcagtcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggcccaacctgggattgctgagcagggaagctttgcatgttgctctaaggtacatttttaaagagttgttttttggccgggcgcagtgctcatgcctgtaatcccagaactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagagagccaagattgcg

SEQ ID NO: 25 - protein, 490 aa, Homo sapiens
MSEVTKNSLEKILPQLKCHFTWNLFKEDSVSRDLEDRVCNQIEFLNTEFKATMYNLLAYIKHLDGNNEAALECLRQAEELIQQEHADQAEIRSLVTWGNYAWVYYHLGRLSDAQIYVDKVKQTCKKFSNPYSIEYSELDCEEGWTQLKCGRNERAKVCFEKALEEKPNNPEFSSGLAIAMYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQQSHQRYCNLQKYNGKSEDTAVQHGLEGLSISKKSTDKEEIKDQPQNVSENLLPQNAPNYWYLQGLIHKQNGDLLQAKCYEKELGRLLRDAPSGIGSIFLSASELEDGSEEMGQGAVSSSPRELLSNSEQLN

SEQ ID NO: 26 - DNA, 1714 bp, Homo sapiens
ggggcattttgtgcctgcctagctatccagacagagcagctaccctcagctctagctgatactacagacagtacaacagatcaagaagtatggcagtgacaactcgtttgacacggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcggaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaatagtaataatttttcttggatttatgttctgtatctgtgaaaaaataaatttcttataaaactcggaaaaaaaaaaaaaaaaaaaaaaaaaaaaa

SEQ ID NO: 27 - protein, 444 aa, Homo sapiens
MAVTTRLTRLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKLEEVQRKLGFALSDISVVSNYSSEWELDPVKDVLILSALRRMLWAADDFLEDLPFEQIGNLREEIINCAQGKK

SEQ ID NO: 28 - DNA, 1145 bp, Homo sapiens
gctccggccagccgcggtccagagcgcgcgaggttcggggagctccgccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgcccaagtgggccagctgccctcacttctggggtggatgatgtgaccttccttgggggactgcggaagggacgagggttccctggagtcttacggtccaacatcagaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgcccaaatccagccagtcctgccccagcccacccccacattggagccctcctgctgctttggtgcctcaaataaatacagatgtcccc

SEQ ID NO: 29 - protein, 131 aa, Homo sapiens
MKIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 30 - DNA, 3502 bp, Homo sapiens
gcgcgcagctggttcccgctctgcagcgcaacgcctgaggcagtgggcgcgctcagtcccgggaccaggcgttctctcctctcgcctctgggcctgggacccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgaaatgcattaaattaggaaaaaacatgaagatacattccgtggaccaaggagcagagcacatgctgattctctcatcagatggaaaaccatttgagtatgacaactatagcatgaaacatctaaggtttgaaagcattttacaagaaaaaaaaataattcagatcacatgtggagattaccattctcttgcactctcaaaaggcggtgagctttttgcctggggacagaacctgcatgggcagcttggagttggaaggaaatttccctcaaccaccacaccacagattgtggagcacctcgcaggagtacccttggctcagatttctgccggagaagcccacagcatggccttatccatgtctggcaacatttattcatggggaaaaaatgaatgtggacaactaggcctgggccacactgagagtaaagatgatccatcccttattgaaggactagacaatcagaaagttgaatttgtcgcttgtggtggctctcacagtgccctactcacacaggatgggctgctgtttactttcggtgctggaaaacatgggcaacttggtcataattcaacacagaatgagctaagaccctgtttggtggctgagcttgttgggtatagagtgactcagatagcatgtggaaggtggcacacacttgcctatgtttctgatttgggaaaggtcttttcctttggttctggaaaagatggacaactgggaaatggtggaacacgtgaccagctgatgccgcttccagtgaaagtatcatcaagtgaagaactcaaacttgaaagccatacctcagaaaaggagttaataatgattgctggagggaatcaaagcattttgctctggataaagaaagagaattcatatgttaatctgaagaggacaattcctactctgaatgaagggactgtaaagagatggattgctgatgtggagactaaacggtggcagagcacaaaaagggaaatccaagagatattttcatctcctgcttgtctaactggaagttttttaaggaaaagaagaactacagaaatgatgcctgtttatttggacttaaataaagcaagaaacatcttcagggagttaacccaaaaggactggattactaacatgataaccacctgcctcaaagataatctgctcaaaagacttccatttcattctccaccccaagaagctttagaaattttcttccttctcccagaatgtcctgtgatgcatatttccaacaactgggagagccttgtggttccatttgcaaaggttgtttgtaaaatgagtgaccagtcttcactggttctggaagagtattgggcaactctgcaagaatccactttcagcaaactggtccagatgtttaaaacagccgtcatatgccagttggattactgggatgaaagtgctgaggagaatggtaatgttcaagctctcctagaaatgttgaagaagctgcacagggtaaaccaggtgaaatgtcaactacctgaaagtattttccaagtagacgaactcttgcaccgtctcaatttttttgtagaagtatgcagaaggtacttgtggaaaatgactgtggacgcttcagaaaatgtacaatgctgcgtcatattcagtcactttccatttatctttaataatctgtcgaaaattaaactactacatacagacacacttttaaaaatagagagtaaaaaacataaagcttatcttaggtcggcagcaattgaggaagaaagagagtctgaattcgctttgaggcccacgtttgatctaacagtcagaaggaatcacttgattgaggatgttttgaatcagctaagtcaatttgagaatgaagacctgaggaaagagttatgggtttcatttagtggagaaattgggtatgacctcggaggagtcaagaaagagttcttctactgtctgtttgcagagatgatccagccggaatatgggatgttcatgtatcctgaaggggcttcctgcatgtggtttcctgtcaagcctaaatttgagaagaaaagatacttcttttttggggttctatgtggactttccctgttcaattgcaatgttgccaacctccctttcccactggcactgtttaagaaacttttggaccaaatgccatcattggaagacttgaaagaactcagtcctgatttgggaaagaatttgcaaacacttctggatgatgaaggtgataactttgaggaagtattttacatccattttaatgtgcactgggacagaaacgacacaaacttaattcctaatggaagtagcataactgtcaaccagactaacaagagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaagaatgcacgttatgaaccaggatataacagttcacatcccaccatagtgatgttttggaaggctttccacaaattgactctggaagaaaagaaaaaattccttgtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcaggaaagagggatgaagaagagggtttactggccggttagaacccgtgactgtattctctcccttggatacccctatgcctacatcatattccttacctcttttgggaaatatttttcaaaaataaaataaccgaaaaactaaaaaaagaaaaaaaaaaaaaaaaaaaaaaa

SEQ ID NO: 31 - protein, 1024 aa, Homo sapiens
MERRSRRKSRRNGRSTAGKAAATQPAKSPGAQLWLFPSAAGLHRALLRRVEVTRQLCCSPGRLAVLERGGAGVQVHQLLAGSGGARTPKCIKLGKNMKIHSVDQGAEHMLILSSDGKPFEYDNYSMKHLRFESILQEKKIIQITCGDYHSLALSKGGELFAWGQNLHGQLGVGRKFPSTTTPQIVEHLAGVPLAQISAGEAHSMALSMSGNIYSWGKNECGQLGLGHTESKDDPSLIEGLDNQKVEFVACGGSHSALLTQDGLLFTFGAGKHGQLGHNSTQNELRPCLVAELVGYRVTQIACGRWHTLAYVSDLGKVFSFGSGKDGQLGNGGTRDQLMPLPVKVSSSEELKLESHTSEKELIMIAGGNQSILLWIKKENSYVNLKRTIPTLNEGTVKRWIADVETKRWQSTKREIQEIFSSPACLTGSFLRKRRTTEMMPVYLDLNKARNIFRELTQKDWITNMITTCLKDNLLKRLPFHSPPQEALEIFFLLPECPVMHISNNWESLVVPFAKVVCKMSDQSSLVLEEYWATLQESTFSKLVQMFKTAVICQLDYWDESAEENGNVQALLEMLKKLHRVNQVKCQLPESIFQVDELLHRLNFFVEVCRRYLWKMTVDASENVQCCVIFSHFPFIFNNLSKIKLLHTDTLLKIESKKHKAYLRSAAIEEERESEFALRPTFDLTVRRNHLIEDVLNQLSQFENEDLRKELWVSFSGEIGYDLGGVKKEFFYCLFAEMIQPEYGMFMYPEGASCMWFPVKPKFEKKRYFFFGVLCGLSLFNCNVANLPFPLALFKKLLDQMPSLEDLKELSPDLGKNLQTLLDDEGDNFEEVFYIHFNVHWDRNDTNLIPNGSSITVNQTNKRDYVSKYINYIFNDSVKAVYEEFRRGFYKMCDEDIIKLFHPEELKDVIVGNTDYDWKTFEKNARYEPGYNSSHPTIVMFWKAFHKLTLEEKKKFLVFLTGTDRLQMKDLNNMKITFCCPESWNERDPIRALTCFSVLFLPKYSTMETVEEALQEAINNNRGFG

SEQ ID NO: 32 - DNA, 579 bp, Homo sapiens
  Unsure 80-119: Unknown base
ggtgaaatggggatggaaaagggttatataaaaacaaataatggtaacaataatgatgaagattggagtactccatctcnnnnnnnnnnnnnnnnnnnnnnnnnnnnnnnnnnnnnnnncatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaatagaggtaattgtgtggtttgtgtatgggactataacagtaatattaattcccaaaatttctcctactaggaacagtgggta

SEQ ID NO: 33 - protein, 56 aa, Homo sapiens
  Unsure 27-40: Unknown amino acid
GEMGMEKGYIKTNNGNNNDEDWSTPSXXXXXXXXXXXXXXMFIIVHYSYIVRRSYN

SEQ ID NO: 34 - DNA, 347 bp, Homo sapiens
tgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctctg

SEQ ID NO: 35 - protein, 39 aa, Homo sapiens
RIKKLPIWYYAFYLDDEIICTTNPGDMQFTYIASLHMCP

SEQ ID NO: 36 - DNA, 3554 bp, Homo sapiens
atatcttataaatgaagtctcctcattttcctgtggtcagaagagagggggcaagcagaaaagcagaggaacaaatttggaggctaaaataacattctacataaggaactatactacagtagaattaattgatagcagggattaagagatgtaaatgaatttgagatacatattctagaggtagaatgtgcaatactttttgtatgtccatatacagaaattggttgcattttccttaaataaaaagattttttaaaagttagtgagctgttatgttttcttccctctgacttcaattccttgattctttcaatttttttaatataaatttactgtctaaaagctggatcagcttatgctcctttgttgagagaagttggcatgctgtcaagtgggctgggcacactgagtttcagtttcctttctctgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaaggtaatgaatgatgcccttcgtaaacacattttctgggctagaggaagtccaaagaaaacagagtaaacatctgccaacgtttattgacagtgctgagcagtgacagataaatatttcgaacctaggcagtttgattctagaggtaaaatagtctaaacaagaattaaacgttaaactggtctaataaaatctacttatccagagaatgttttttaaaagaaacaggaaatatatggactgtaggataggtgtcataaaaattttgtttctaaatcatttagaatccactgcatgtattccaaattacaattatcagtgacattagaacttgatatgtgaagttcttcaagagtactttgtgagaccagatctccatttttttccaatgggaaattattgcaagttcctacatcttgatattgctttcgtaatttatactaacataaaataatatttttcactgttttgcaatgtctttttaatttctgtattgcagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaataggtagatgtgtttggtggtgtggaagcttggaagcggtcaggtagttggctactttctgcttggatctattaaatacctggcagctctctgtctttttgtgggttgttgccctgtgattagttctgctttttaacccactccctggatgcatttttccctccttgcatttccctcttttcctggagttcatactagagaatctgcactatgtttttccctttttgtcttgagatgaaagttttaaaataatccacctctgtcatttccactctctgaacatcccaagctgtatccctggcctcttttctcagactatgtttctttacttgggacctagaactggattggattggcattgctcctgatcagatgagacctttgattatttgccccttccttaggaccttacactcctgtctttctttgacttgcctttttgtttctttccttcatcttagtccctcttcatgcagtatggtcattgctaggtagaggtatgtccttttatgtaatggccaccgcatttagtattacataaactttcttttaacaatctgtgcatagtacatgctgctctgttccatttagagatttgacagaggtttcagtttagtatactcaaatcttattttagtgcttgggaaatcaattcagaatatcacatcctctccaattctctcttactcaaattgctgggaaactctcatgttactaactttgttgctctaactctgccatcttggtttccccatcccttctcttcctcatggtacgtgtgctcctaatattagcgttggttgagattttcagtggtccaatattcctcttccctctggttgcctttcctgagataatccactaagaatattttgtgtttcttttctcagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcggaagtatgtagtcgggtaccg

SEQ ID NO: 37 - protein, 392 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKVMNDALRKHIFWARGSPKKTE

SEQ ID NO: 38 - DNA, 2952 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtgttctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaaaaaaaaaa

SEQ ID NO: 39 - protein, 781 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 40 - DNA, 1924 bp, Homo sapiens
cgcccgggcaggttagaattcagcgaccgcttaattctaggctcagtcccgacgtggaactcagcagcggaggctggacgcttgcatggcgcttgagagattccatcgtgcctggctcacataagcgcttcctggaagtgaagtcgtgctgtcctgaacgcgggccaggcagctgcggcctgggggttttggagtgatcacgaatgagcaaggcgtttgggctcctgaggcaaatctgtcagtccatcctggctgagtcctcgcagtccccggcagatcttgaagaaaagaaggaagaagacagcaacatgaagagagagcagcccagagagcgtcccagggcctgggactaccctcatggcctggttggtttacacaacattggacagacctgctgccttaactccttgattcaggtgttcgtaatgaatgtggacttcaccaggatattgaagaggatcacggtgcccaggggagctgacgagcagaggagaagcgtccctttccagatgcttctgctgctggagaagatgcaggacagccggcagaaagcagtgcggcccctggagctggcctactgcctgcagaagtgcaacgtgcccttgtttgtccaacatgatgctgcccaactgtacctcaaactctggaacctgattaaggaccagatcactgatgtgcacttggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggaggacgccctgcactgcttcttccagcccagggagttatcaagcaaaagcaagtgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggtcttgcttcaatgactccaatatttgcttggtgtcctgggaagacatccagtgtacctacggaaatcctaactaccactggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgaccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgagcatctcttctccataagatagtgtgataaacacggtcatgaataaagttattttccccgaaaaaaaaaaaaaaaaaaaaaaaaaa

SEQ ID NO: 41 - protein, 372 aa, Homo sapiens
MSKAFGLLRQICQSILAESSQSPADLEEKKEEDSNMKREQPRERPRAWDYPHGLVGLHNIGQTCCLNSLIQVFVMNVDFTRILKRITVPRGADEQRRSVPFQMLLLLEKMQDSRQKAVRPLELAYCLQKCNVPLFVQHDAAQLYLKLWNLIKDQITDVHLVERLQALYTIRVKDSLICVDCAMESSRNSSMLTLPLSLFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWSCFNDSNICLVSWEDIQCTYGNPNYHWQETAYLLVYMKMEC

SEQ ID NO: 42 - DNA, 1508 bp, Homo sapiens
cgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaaactctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtaaaaaaaaaaaa

SEQ ID NO: 43 - protein, 307 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 44 - DNA, 1590 bp, Homo sapiens
gaggcagttctgttgccactctctctcctgtcaatgatggatctcagaaataccccagccaaatctctggacaagttcattgaagactatctcttgccagacacgtgtttccgcatgcaaatcgaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcactttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcagctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccaaggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggctgaaagcaacagtacagacgatgagaccgacgatcccaggacgtatcagaaatatggttacattggaacacatgagtaccctcatttctctcatagacccagcacgctccaggcagcatccaccccacaggcagaagaggactggacctgcaccatcctctgaatgccagtgcatcttgggggaaagggctccagtgttatctggaccagttccttcattttcaggtgggactcttgatccagagaagacaaagctcctcagtgagctggtgtataatccaagacagaacccaagtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaa

SEQ ID NO: 45 - protein, 400 aa, Homo sapiens
MMDLRNTPAKSLDKFIEDYLLPDTCFRMQIDHAIDIICGFLKERCFRGSSYPVCVSKVVKGGSSGKGTTLRGRSDADLVVFLSPLTTFQDQLNRRGEFIQEIRRQLEACQRERALSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLAESNSTDDETDDPRTYQKYGYIGTHEYPHFSHRPSTLQAASTPQAEEDWTCTIL

SEQ ID NO: 46 - DNA, 1590 bp, Homo sapiens; identical to SEQ ID NO: 44

SEQ ID NO: 47 - protein, 400 aa, Homo sapiens; identical to SEQ ID NO: 45

SEQ ID NO: 48 - DNA, 2355 bp, Homo sapiens
gcagaggaggcggcggaacaccccgggttggtcgggtttccaagggctgacccgagctccagcactttttccgcgcctgatttttcagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactaaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccatagattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttgaaaaaaaaaaaaaaaaaaaa

SEQ ID NO: 49 - protein, 558 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTNLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 50 - DNA, 3468 bp, Homo sapiens
gggggaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggcggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacataaagcagtgttctggttcatctggaattttgctgtactttaaatctttcagactcagctactgataaatgaaacgttacacaggtgtgaaccaaatccaaataacctcgactggtctactatcataatcacctgaacagaacaaaactttttcctcagctttaagagtccagggcttcggataacagctgccatctgccacctgctaccattgacctacgtgaacacagacattctgtctccaccttgatggtgggtgggctgctccccttttctttgttaaattttgtgctttcatcacattttctctattctgacctctgttatgagaaataaaagtcactgattccatttt

SEQ ID NO: 51 - protein, 521 aa, Homo sapiens
GEGKQTKRNQRPLVYIGLFSIYWWQKRKISEECSCLNRALPNSENCTATMSENNKNSLESSLRQLKCHFTWNLMEGENSLDDFEDKVFYRTEFQNREFKATMCNLLAYLKHLKGQNEAALECLRKAEELIQQEHADQAEIRSLVTWGNYAWVYYHMGRLSDVQIYVDKVKHVCEKFSSPYRIESPELDCEEGWTRLKCGGNQNERAKVCFEKALEKKPKNPEFTSGLAIASYRLDNWPPSQNAIDPLRQAIRLNPDNQYLKVLLALKLHKMREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEEAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGE

SEQ ID NO: 52 - DNA, 6270 bp, Homo sapiens
gccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccgcggtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctaggcgaaggcctccgaactgtcctgggcctgatccaacagcatcagcacctgtgtgttttctggactgtcaactatggcttcgaggaccctgcagttgggcagttcttgcagcggcacgttaagagacccaggcctgtgatcctggacccagctgaccccacatgggacctggggaatggggcagcctggcactgggatttgcatgcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactgcggagccagcatcgtacccctctgtgccgggaatggccttggacctgtctcagatccccaccaaggagctggaccgcttcatccaggaccacctgaagccgagcccccagttccaggagcaggtgaaaaaggccatcgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcacgtagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcagtgtaccaagatctccaaggggagaggctccctacccccacagcacgggctggaactcctgactgtgtatgcctgggagcagggcgggaaggactcccagttcaacatggctgagggcttccgcacggtcctggagctggtcacccagtaccgccagctctgtatctactggaccatcaactacaacgccaaggacaagactgttggagacttcctgaaacagcagcttcagaagcccaggcctatcatcctggatccggctgacccgacaggcaacctgggccacaatgcccgctgggacctgctggccaaggaagctgcagcctgcacatctgccctgtgctgcatgggacggaatggcatccccatccagccatggccagtgaaggctgctgtgtgaagttgagaaaatcagcggtcctactggatgaagagaagatggacaccagccctcagcatgaggaaattcagggtcccctaccagatgagagagattgtgtacatgtgtgtgtgagcacatgtgtgcatgtgtgtgcacacgtgtgcatgtgtgtgttttagtgaatctgctctcccagctcacacactcccctgcctcccatggcttacacactaggatccagactccatggtttgacaccagcctgcgtttgcagcttctctgtcacttccatgactctatcctcataccaccactgctgcttcccacccagctgagaatgccccctcctccctgactcctctctgcccatgcaaattagctcacatctttcctcctgctgcaatccatcccttcctcccattggcctctccttgccaaatctaaatactttatatagggatggcagagagttcccatctcatctgtcagccacagtcatttggtactggctacctggagccttatcttctgaagggttttaaagaatggccaattagctgagaagaattatctaatcaattagtgatgtctgccatggatgcagtagaggaaagtggtggtacaagtgccatgattgattagcaatgtctgcactggatatggaaaaaagaaggtgcttgcaggtttacagtgtatatgtgggctattgaagagccctctgagctcggttgctagcaggagagcatgcccatattggcttactttgtctgccacagacacagacagagggagttgggacatgcatgctatggggaccctcttgttggacacctaattggatgcctcttcatgagaggcctccttttcttcaccttttatgctgcactcctcccctagtttacacatcttgatgctgtggctcagtttgccttcctgaatttttattgggtccctgttttctctcctaacatgctgagattctgcatccccacagcctaaactgagccagtggccaaacaaccgtgctcagcctgtttctctctgccctctagagcaaggcccaccaggtccatccaggaggctctcctgacctcaagtccaacaacagtgtccacactagtcaaggttcagcccagaaaacagaaagcactctaggaatcttaggcagaaagggattttatctaaatcactggaaaggctggaggagcagaaggcagaggccaccactggactattggtttcaatattagaccactgtagccgaatcagaggccagagagcagccactgctactgctaatgccaccactacccctgccatcactgccccacatggacaaaactggagtcgagacctaggttagattcctgcaaccacaaacatccatcagggatggccagctgccagagctgcgggaagacggatcccacctccctttcttagcagaatctaaattacagccagacctctggctgcagaggagtctgagacatgtatgattgaatgggtgccaagtgccagggggcggagtccccagcagatgcatcctggccatctgttgcgtggatgagggagtgggtctatctcagaggaaggaacaggaaacaaagaaaggaagccactgaacatcccttctctgctccacaggagtgtcttagacagcctgactctccacaaaccactgttaaaacttacctgctaggaatgctagattgaatgggatgggaagagccttccctcattattgtcattcttggagagaggtgagcaaccaagggaagctcctctgattcacctagaacctgttctctgccgtctttggctcagcctacagagactagagtaggtgaagggacagaggacagggcttctaatacctgtgccatattgacagcctccatccctgtcccccatcttggtgctgaaccaacgctaagggcaccttcttagactcacctcatcgatactgcctggtaatccaaagctagaactctcaggaccccaaactccacctcttggattggccctggctgctgccacacacatatccaagagctcagggccagttctggtgggcagcagagacctgctctgccaagttgtccagcagcagagtggccctggcctgggcatcacaagccagtgatgctcctgggaagaccaggtggcaggtcgcagttgggtaccttccattcccaccacacagactctgggcctccccgcaaaatggctccagaattagagtaattatgagatggtgggaaccagagcaactcaggtgcatgatacaaggagaggttgtcatctgggtagggcagagaggagggcttgctcatctgaacaggggtgtatttcattccaggccctcagtctttggcaatggccaccctggtgttggcatattggccccactgtaacttttgggggcttcccggtctagccacaccctcggatggaaagacttgactgcataaagatgtcagttctccctgagttgattgataggcttaatggtcaccctaaaaacacccacatatgcttttcgatggaaccagataagttgacgctaaagttcttatggaaaaatacacacgcaatagctaggaaaacacagggaaagaagagttctgagcagggcctagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtttaatttttaaaaagtttttattcggaatccgcg

SEQ ID NO: 53 - protein, 1087 aa, Homo sapiens
MDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSAVKPKPQVYSTLLNSGCQGGEHAACFTELRRNFVNIRPAKLKNLILLVKHWYHQVCLQGLWKETLPPVYALELLTIFAWEQGCKKDAFSLGEGLRTVLGLIQQHQHLCVFWTVNYGFEDPAVGQFLQRHVKRPRPVILDPADPTWDLGNGAAWHWDLHAQEAASCYDHPCFLRGMGDPVQSWKGPGLPRAGCSGLGHPIQLDPNQKTPENSKSLNAVYPRAGSKPPSCPAPGPTAEPASYPSVPGMALDLSQIPTKELDRFIQDHLKPSPQFQEQVKKAIDIILRCLHENCVHKASRVSKGGSFGRGTDLRDGCDVELIIFLNCFTDYKDQGPRRAEILDEMRAHVESWWQDQVPSLSLQFPEQNVPEALQFQLVSTALKSWTDVSLLPAFDAVGQLSSGTKPNPQVYSRLLTSGCQEGEHKACFAELRRNFMNIRPVKLKNLILLVKHWYRQVAAQNKGKGPAPASLPPAYALELLTIFAWEQGCRQDCFNMAQGFRTVLGLVQQHQQLCVYWTVNYSTEDPAMRMHLLGQLRKPRPLVLDPADPTWNVGHGSWELLAQEAAALGMQACFLSRDGTSVQPWDVMPALLYQTPAGDLDKFISEFLQPNRQFLAQVNKAVDTICSFLKENCFRNSPIKVIKVVKGGSSAKGTALRGRSDADLVVFLSCFSQFTEQGNKRAEIISEIRAQLEACQQERQFEVKFEVSKWENPRVLSFSLTSQTMLDQSVDFDVLPAFDALGQLVSGSRPSSQVYVDLIHSYSNAGEYSTCFTELQRDFIISRPTKLKSLIRLVKHWYQQCTKISKGRGSLPPQHGLELLTVYAWEQGGKDSQFNMAEGFRTVLELVTQYRQLCIYWTINYNAKDKTVGDFLKQQLQKPRPIILDPADPTGNLGHNARWDLLAKEAAACTSALCCMGRNGIPIQPWPVKAAV

SEQ ID NO: 54 - DNA, 3178 bp, Homo sapiens
ggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacagctggaaccagttcatcaaccgtcagccacacaactgggaacaccactcaacccagtaaccagaccacccttccagcaactttatcgatagcactgcacaaaagcacaaccggtcagaagcctgatcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacgggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaattgctagactaagaattaggtggctacagatggtagaactaaacaataagcaagagacaataataatggcccttaattattaacaaagtgccagagtctaggctaagcactttatctatatctcatttcattctcacaacttataagtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgcaataaaaacttactttgg

SEQ ID NO: 55 - protein, 416 aa, Homo sapiens
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTAGTSSSTVSHTTGNTTQPSNQTTLPATLSIALHKSTTGQKPDQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETVYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 56 - DNA, 1820 bp, Homo sapiens
acagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctcttgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcatagggagaccccgtctctacaaaataaaaaaataattcactggg

SEQ ID NO: 57 - protein, 514 aa, Homo sapiens
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQYVKARSPRANLPPLYALELLTIYAWEMGTEEDENFMLDEGFTTVMDLLLEYEVICIYWTKYYTLHNAIIEDCVRKQLKKERPIILDPADPTLNVAEGYRWDIVAQRASQCLKQDCCYDNRENPISSWNVKRARDIHLTVEQRGYPDFNLIVNPYEPIRKVKEKIRRTRGYSGLQRLSFQVPGSERQLLSSRCSLAKYGIFSHTHIYLLETIPSEIQVFVKNPDGGSYAYAINPNSFILGLKQQIEDQQGLPKKQQQLEFQGQVLQDWLGLGIYGIQDSDTLILSKKKGEALFPAS

SEQ ID NO: 58 - DNA, 597 bp, Homo sapiens
agctgaagttgaggatctcttactctctaagccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtgggtactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctgggtgaaatataccaaattctgcatctccagaggaaaataagaaataaagatgaattgttgcaactcttaaaaaaa

SEQ ID NO: 59 - protein, 122 aa, Homo sapiens
MEASALTSSAVTSVAKVVRVASGSAVVLPLARIATVVIGGVVAMAAVPMVLSAMGFTAAGIASSSIAAKMMSAAAIANGGGVASGSLVGTLQSLGATGLSGLTKFILGSIGSAIAAVIARFY

SEQ ID NO: 60 - DNA, 3328 bp, Homo sapiens
ctcagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaaaaaaaa

SEQ ID NO: 61 - protein, 1003 aa, Homo sapiens
MPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 62 - DNA, 3667 bp, Homo sapiens
tgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaaagtcatagttatgtctttgcaatagatgaagtacttgaaaaagtgaggaagacacagaaaaggatcactaaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggatagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctattgtttttgcccaagactcagtctatctggatgctttaaattacagacagatgtctggtcgtgctggaagaagaggtcaagacctgcttggaaatgtgtatttctttgatatcccattgcccaaaataaaaaagactccttgcatccagtgttcctgagctgagaggacagttccctctcagcataaccctggtcctgcgactcatgctgctggcttccaagggagatgacccagaggatgccaaggcaaaggtgttgtcagtgctaaagcattcattgctgtcttttaagagacgaagagccatggagactttgaaactttactttttgttttccttgcagctccttatcaaagaggactatttaaataaaaagggtaatccaaagaaatttgcaggacttgcatcatatttgcatggtcatgaaccttcaaatcttgtttttgtaaattttctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctgatttaagtttttctcagtcaaaggtgatccttgccgaactcccggaggattttaaagctgctttatatgagtataacctggcagtaatgaaggattttgcctccttcctgctgattgcttccaagtcggtgaacatgaaaaaagagcatcaactccctttgtcaagaatcaaattcacaggtaaagaatgtgaagactcccaactcgtgtctcacttgatgagctgcaagaaaggaagagtagccatttcaccatttgtttgtctttcggggaacacagataatgatttgcttcgaccagagactatcaaccaggtcatcctgcgcacagtcggtgttagtggcactcaggctcctctgctgtggccatggaaattagataaccgaggaaggagaatgccactaaatgcatatgtgctcaatttctataaacacaactgcttgacaagattagaccaaaaaaatgggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatctctttgcaaggagagatataattaagcttacacaatgaaatggaaaaaatgtttgtcttggagtcaaacagaattaaactcagataccagctctgctattttctaactgaatgactttaagttatgtaatatatctgagctttaacttcatttttggcaaaaccagagtaaaaatgaatacctctagttgttttgaggattaaatgagataatgtaagaaaagtgattgggattgggtggtgacttaatgaacggtagtggttttttaagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattcaactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgggtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattg

SEQ ID NO: 63 - protein, 751 aa, Homo sapiens
VLCGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTESHSYVFAIDEVLEKVRKTQKRITKKKPKEGEKLERKKVYRAEYINFLENLKILEISEDCTYADVKALHTEITRNKDSTLDRVLPRVRFTRHGKELKALAQRGIGYHHSSMYFKEKEFVEILFVKGLIRVVTATETLALGIHMPCKSIVFAQDSVYLDALNYRQMSGRAGRRGQDLLGNVYFFDIPLPKIKKRLLASSVPELRGQFPLSITLVLRLMLLASKGDDPEDAKAKVLSVLKHSLLSFKRRRAMETLKLYFLFSLQLLIKEDYLNKKGNPKKFAGLASYLHGHEPSNLVFVNFLKRGLFHNLCKPAWKGSQQFSQDVMEKLVLVLANLFGRKYIPAKFQNADLSFSQSKVILAELPEDFKAALYEYNLAVMKDFASFLLIASKSVNMKKEHQLPLSRIKFTGKECEDSQLVSHLMSCKKGRVAISPFVCLSGNTDNDLLRPETINQVILRTVGVSGTQAPLLWPWKLDNRGRRMPLNAYVLNFYKHNCLTRLDQKNGMRVGQLLKCLKDFAFNIQAISDSLSELCENKRDNVVLAFKQLSQTFYEKLQEMQIQMSQNHLE

SEQ ID NO: 64 - DNA, 2984 bp, Homo sapiens
taactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggatcccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattatatactcagagaacagaagtgcaatgtgatgggaggaacgtagcaatatctgctccttttcgagttgtttgagaaatgtaggctattttttcagtgtatatccactcagattttgtgtatttttgatgtacccacactgttctctaaattctgaatctttgggaaaaaatgtaaagcatttatgatctcagaggttaacttatttaagggggatgtacatattctctgaaactaggatgcatgcaattgtgttggaagtgtccttggtcgccttgtgtgatgtagacaaatgttacaaggctgcatgtaaatgggttgccttattatggagaaaaaaatcactccctgagtttagtatggctgtatatttatgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagatataatggatggtttgtgactatagtgtaaataaatacttttcaacaat

SEQ ID NO: 65 - protein, 476 aa, Homo sapiens
MMTAKAVDKIPVTLSGFVHQLSDNIYPVEDLAATSVTIFPNAELGGPFDQMNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 66 - DNA, 3065 bp, Homo sapiens
tagttattaaagttcctatgcagctccgcctccgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgaagagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtccctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaataaaaaaaaaaaa

SEQ ID NO: 67 - protein, 925 aa, Homo sapiens [sequence omitted]

SEQ ID NO: 68 - DNA, 2077 bp, Homo sapiens
ccgagcgccagcgcggggaaccgggaaaaggaaaccgtgttgtgtacgtaagattcaggaaacgaaaccaggagccgcgggtgttggcgcaaaggttactcccagacccttttccggctgacttctgagaaggttgcgcacagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgt

SEQ ID NO: 69 - protein, 318 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 70 - DNA, 1414 bp, Homo sapiens
gaattcgcactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgatgatttggaaaaactggcattattgattatggaatccgtctcaataggagtgaaagatgggatgcctattgctacaacccacacgcaaaggagtgtggtggcgtctttacagatccaaagcgaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaggatgatcaaaacacacagtgtttatgttggaatcttttggaactcctttgatctcactgttattattaacatttatttattatttttctaaatgtgaaagaaatacataatttagggaaaattggaaaatataggaaactttaaacgagaaaatgaaacctctcataatcccactgcatagaaataacaagcgttaacattttcatatttttttctttcagtcatttttgtatttgtggtatatgtatatatgtacctatatgtatttgcatttgaaattttggaatcctgctctatgtacagttttgtattatactttttaaatcttgaactttatgaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttcggaattc

SEQ ID NO: 71 - DNA, 3132 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaacggtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtatcccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaaaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttcttttttttttttgaaagtgttttttcttcgtccttttggtttaaaaagtttcacgtcttggtgccttttgtgtgatgccccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 72 - protein, 543 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 73 - DNA, 1906 bp, Homo sapiens
aatctgtggtttttgctcaaaactcagtctatctggatgcgttgaattatagacagatgtctggccgtgctggaagaagaggtcaagacctgatgggagatgtatatttctttgatattccattccccaaaataggaaaactcataaaatccaatgttcctgagctgagaggacacttccctctcagcataaccctggtcctgcgactcatgctgctggcttccaagggagatgacccagaggatgccaaggcaaaggtgctatcagtgctaaagcattcattgctgtccttcaagcaacccagagtcatggacatgttaaaactttacttcctgttttctttgcagttcctggtgaaagagggctatttagatcaagaaggtaatcctatggggtttgctggacttgtgtcacatttgcattatcatgaaccttctaatcttgtttttgtgagttttcttgtaaatggcctcttccatgatctctgtcagccaaccaggaaaggctcaaaacatttttctcaagacgttatggaaaagctagtattagtattggcacatctctttggaagaagatattttccaccaaagttccaggatgcacacttcgagttttatcaatcaaaggtgttccttgatgatctccctgaggattttagtgatgctttagatgaatataacatgaaaattatggaggactttaccactttcctacgaattgtttccaaactggctgatatgaatcaggaatatcaactcccattgtcaaaaatcaaattcacaggtaaagaatgtgaagactctcaactcgtatctcatttgatgagctgcaaggaaggaagagtagcaatttcaccatttgtttgtctgtctgggaactttgatgatgatttgcttcgactagaaactccaaaccatgttactctaggcacaatcggtgtcaatcgctctcaggctccagtgctgttgtcacagaaatttgataaccgaggaaggaaaatgtcgcttaatgcctatgcactggatttctacaaacatggttccttgataggattagtccaggataacaggatgaatgaaggagatgcttattatttgttgaaggattttgcactcaccattaaatctatcagtgtttccttgcgtgagctatgtgaaaatgaagacgacaacgttgtcttagcctttgaacaactgagtacaactttttgggaaaagttaaacaaagtctaaaaacaaagtctatgcaaaccactcaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatattatcagtaactttatccccagtgtcagtatttataaaatgtttattaaggctagaaaaaatgaatacaatatcctgaaggtgaaatatattctcttcaattagcataaatatgatttacataagttagctatacagctattgagatagtactttctagtaaacttaaactactttttaaacatacattttgtgttgatttaacaaaaatatagagaatgatttgctttattgtaattgtatataagtgactggaaaagcacaaagaaataaagtgggttcgatctgtttaccaaaaaaaaaaaaaaaaaaaaaaaaaaaaaaaaa

SEQ ID NO: 74 - protein, 391 aa, Homo sapiens
MSGRAGRRGQDLMGDVYFFDIPFPKIGKLIKSNVPELRGHFPLSITLVLRLMLLASKGDDPEDAKAKVLSVLKHSLLSFKQPRVMDMLKLYFLFSLQFLVKEGYLDQEGNPMGFAGLVSHLHYHEPSNLVFVSFLVNGLFHDLCQPTRKGSKHFSQDVMEKLVLVLAHLFGRRYFPPKFQDAHFEFYQSKVFLDDLPEDFSDALDEYNMKIMEDFTTFLRIVSKLADMNQEYQLPLSKIKFTGKECEDSQLVSHLMSCKEGRVAISPFVCLSGNFDDDLLRLETPNHVTLGTIGVNRSQAPVLLSQKFDNRGRKMSLNAYALDFYKHGSLIGLVQDNRMNEGDAYYLLKDFALTIKSISVSLRELCENEDDNVVLAFEQLSTTFWEKLNKV

SEQ ID NO: 75 - DNA, 3906 bp, Homo sapiens
ctggcgcgcgcacgcgcacgcgcacgcccaccgcgcggcttcccccgctccccggtgctgaggagagagcgatccgagggactgcgccgcccggacggcctgcagagcgctgccatcatgagtgaaattcgtaaggacaccttgaaggccattctgttggagttagaatgtcattttacatggaatttacttaaggaagacattgatctgtttgaggtagaagatacaattgggcaacagcttgaatttcttaccacaaaatctagacttgctctttataacctattggcctatgtgaaacacctaaaaggccaaaataaagacgcccttgagtgcttggaacaagcagaagaaataatccagcaagaacactcagacaaagaagaagtacgaagcctggtcacttggggaaactatgcctgggtgtattatcacatggaccagcttgaagaagctcagaagtatacaggtaagatagggaatgtctgtaagaaattgtccagtccttctaactacaagttggagtgtcctgagactgactgtgagaaaggctgggcactcttgaaatttggaggaaagtattatcaaaaggctaaagcggcttttgagaaggctctggaagtggagcctgacaatccagaatttaacatcggctatgctatcacagtgtatcggctggatgattctgatagagaagggtctgtaaagagcttttctctggggcctttgagaaaggctgttaccctgaacccagataacagctatattaaggtttttctggcactgaagcttcaagatgtacatgcagaagctgaaggggaaaagtatattgaagaaatcctggaccaaatatcatcccagccttacgtccttcgttatgcagccaagttctataggagaaaaaattcctggaacaaagctctcgaacttttaaaaaaggccttggaggtgacaccaacttcttctttcctgcatcaccagatgggactttgctacagggcacaaatgatccaaatcaagaaggccacacacaacagacctaaaggaaaggataaactaaaggttgatgagctgatttcatctgctatatttcatttcaaagcagccatggaacgagactctatgtttgcatttgcctacacagacctggccaacatgtatgctgaaggaggccagtatagcaatgctgaggacattttccggaaagctcttcgtctggagaacataaccgatgatcacaaacatcagatccattaccactatggccgctttcaggaatttcaccgtaaatcagaaaatactgccatccatcattatttagaagccttaaaggtcaaagacagatcaccccttcgcaccaaactgacaagtgctctgaagaaattgtctaccaagagactttgtcacaatgctttagatgtgcagagtttaagtgccctagggtttgtttacaagctggaaggagaaaagaggcaagctgctgagtactatgagaaggcacaaaagatagatccagaaaatgcagaattcctgactgctctctgtgagctccgactttccatttaaatacatactctaggaaattagctctaagtttttcccttcattttgggttctcctgtttgttttttttttattattttaatcccttgtttattatagagctaatatttattgaatagttattgtgtaccaagcattgtgctaaatactttatatgcattatgatgaatcttgtgcggttttctttctttttttctttttaattaaaatactataatccattgagaaatagcaatattctagctattgtaacttctaaaaatggtatggccattagatctgtgctttttatctctgctctttgaatttctcatattatatagtaaatatattcctacgtaaacctttgatacctagatcaggaatactcttccaggagtacaaaattacattattgatagttaagctcttaattgtgtagcttgcaaaagacagcactttttagttacagatgttttgactttgatgaggatatttagctatcaatctaatagtcacctaaaatatcttttttgttggaaaaaagtttataataaaaaagtttgtcatctctagtgacttcaataaagaaaaaactagaagaggagaaaaaggatttcctcaaattttaaatatgtaacttcagggattcaatccccaaatgtttattaagtagctagaaataattatgtggaaaaaaatgaataatggaaaatagtgagtctcaaattgtttttttttaactaaaatctgcaatgaatctagatgcaattaattttattccttccaactaaaattacaatatttttaggttaaaattattgagatataaagcagccattgggaaattgggagaaatgataaacaaatggaaaaagaagatgtccctaacctacacccatagattaccaaggtttcagtgtactagttttgaatctgttctgaatggagtttttataccctcaatttctggcctttggctattttagcatttcaaagtgacttctatgaagctttttttttaatgtgaaattttcagaatgttgtttttttcatgtagatactccaggaagagttaagcactgctttcagttttaatatccaccttgaggggtcgctgcttgagggctcttatcccaggggactttttaattcggatgttacttaatgtggcttctctaatgtagtttctttgattaccgactacacaattatgtaccatcacagtattagtggaaaagtaccatgtgatttaattctccattcctccaatgtaactcttaaaattattatgtatgtgtatgtgttttactttttgttttttatcatctttaaaatttctattatggtttgattattataaaaataatgaattctcactgtaaatttcaaaaaaaaaattacaaaagtatgtgaatttaaaaatgagagcagtcccctcaccctaccacagttccacaccctcaaggtaaacttataacttataatttgatatgtaaacttccagatcttttttctatgcgtaatcagacatacatatatactgcagtgtatctcacgtattaatttttaaaaatcttttgttttacttaattctgtttttattattattattattttgtttgatctattaaggaagaacaaggaagggaatgatctttactcaagaatttcagaaagtcagcactgaagtcctgacctatcagtagacacatttgtccctttcagatattttaggatattctagcaaagcaggccatttctcccacctgaaagtacataacttctatcacttgccacataattaaaagaactcacattaagcggttactcagacagttaatcatagaaaagattatttgcttcatcagttcatagaaaagattatttgcttcatcagttaacttgtttttataaatcagggcctgtgttcatacacagaaggggcctgagatttctgcactttaaacaagctcctcctaggtgaggatgctgtggctgttctaattacattttgagtagtaaggtctacagcattgttcctcaaacttggctacgtattggaatcacctaaaaagttaaaacaaaacatggatgtctgggtcccgccccatagagaatgacttaattggcatggggtgcagtccaggcatcatgatttttagatttcccagttggaacttgtgcagcaaagtttgggagctactgatggacatgtgaaaagtaagtataaatggaataaaattaattaggctaataggcttaacccaggaaatcctaagttccttgaatatccagtttgcatttgggactcctcatcatatacttggtatataatactctaataaaagctgcctgagttga

SEQ ID NO: 76 - protein, 482 aa, Homo sapiens
MSEIRKDTLKAILLELECHFTWNLLKEDIDLFEVEDTIGQQLEFLTTKSRLALYNLLAYVKHLKGQNKDALECLEQAEEIIQQEHSDKEEVRSLVTWGNYAWVYYHMDQLEEAQKYTGKIGNVCKKLSSPSNYKLECPETDCEKGWALLKFGGKYYQKAKAAFEKALEVEPDNPEFNIGYAITVYRLDDSDREGSVKSFSLGPLRKAVTLNPDNSYIKVFLALKLQDVHAEAEGEKYIEEILDQISSQPYVLRYAAKFYRRKNSWNKALELLKKALEVTPTSSFLHHQMGLCYRAQMIQIKKATHNRPKGKDKLKVDELISSAIFHFKAAMERDSMFAFAYTDLANMYAEGGQYSNAEDIFRKALRLENITDDHKHQIHYHYGRFQEFHRKSENTAIHHYLEALKVKDRSPLRTKLTSALKKLSTKRLCHNALDVQSLSALGFVYKLEGEKRQAAEYYEKAQKIDPENAEFLTALCELRLSI

SEQ ID NO: 77 - DNA, 2224 bp, Homo sapiens
gctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcggtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcaggtcgtcgtcccgcagacacacaatccagaagtcactttcctcgagacattggtcagcccatcactcccagccactcgaagctcacccccaagctggaaactatgactcttggaaacaggagtcacaaagctgcagaaggcagccactatgtggatgaagcctcacacgaggggagctggtggggaggtgggatttagtgcacagcctcacgtggggcttggacacaggctgggggtgggcgcatgctagggagactagcctgctgctctctgcattccttagcgtcttgtttgacctgcttgcttccagacataacctgcatgaatcagttttgggggaatggacctggcatggggatgggttcaggccaggtcttttgatggccaggagtagatgacagggagttgccttggggaacctttggtgtgccaagaggaggtgggtagatgggagtggggctcggtcccccaggcccaggggactctctccactctttcctgggctcggggcatctgcctggagttaccttccatcatggctacctgctgtggtttgaatgtttgagtcccaacaaaattcatatcaaaacataatcccaactgggtgcagtggctcacgcctgtaatcccagcactttgggaggccgaggcgggcggatcaataggtcaggaaatccagaccgtcctggctaacatggtgaaaccccgtctctactaaaaaaaaaaatacaaaaaattagccgggcgttgtggcgggcacctggagtcccagctactccggaggctgagggaggagaatggtgtgaacccgggaggtggagcttccagtgagccgagatcgcgccactgcactccaggctgggcgacagagcgagactccgtctcaaaaaaataaatacataaataaaaaataaaccacccataaaaaaaaaaaaaaaaaaaaaaaaaaaaaaa

SEQ ID NO: 78 - protein, 429 aa, Homo sapiens
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMERSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 79 - DNA, 722 bp, Homo sapiens
ggactttaaaaaataaaccaaaaaacccacaatttcttcacatctttcatgcatttaatgttttgcacaacttgcttgttttgcaaatatgcgcacatttctatgacaagatttattgctaaatattctttaaaactgcagcagttcagataagatactgtcgaaaggacgtttggcccagcagcaggacctccaccaatgaacggactccaattcttgatttgagccttgggaaccaatcaactttgtttccaagagtttatgtgaacttccctcctttaccagtaaaatcttccccctattcttcccttctccagacccgtggcttgccatagctgtacatcttggattataattctttttgttcactcccaaagaaactcagtatctttggagaattctttctttgttgtcttttagcttcccagagccaaacaagaaatattttaggttttgtgggtcatgctggcttggtcacagctattcaacttgtatcttaaaattagccatagacagtatgaatgggtgggtctctgttccaataaaaccttatcctaaacactgaagtttgaattttatgtaattttcaactgtcatgaaatactcatcttttgatctttttcagccactgaaaaatgtaaaagccatccttaagttgcaagctatacaaaaacagacagtggactggatttgacccttgagccatttgtccatgtgccctc

SEQ ID NO: 80 - protein, 39 aa, Homo sapiens
TLKNKPKNPQFLHIFHAFNVLHNLLVLQICAHFYDKIYC

SEQ ID NO: 81 - DNA, 1826 bp, Homo sapiens
agtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctgggcagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttgcccctgccacctcctgcctcaggtgtccgctatccaccaaaagggctcctgagggtctgggcaagggacctgcttctattagcccttctccatggccctgccatgctctccaaaccactttttgcagctttctctagttcaagttcaccagactctataaataaaacctgacagaccat

SEQ ID NO: 82 - protein, 500 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGQNTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 83 - DNA, 3243 bp, Homo sapiens
gggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgattaaaaaaaaaaaa

SEQ ID NO: 84 - protein, 854 aa, Homo sapiens
MDFSMVAGAAAYNEKSGRITSLSLLFQKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMCEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 85 - DNA, 2621 bp, Homo sapiens
  Unsure 2086-2106: Unknown base
ttccagattaagtttttaaccagagtcaaacttagcctttataaaaagtcctcatttaatttcaaaatagatcttctgtaagacatgcacatagggaagacctacctaggaatagcctggtgaaatgcagaattggaaaaaggcaaaagtccttgctcatgactcagaactacatcgagtgaagtcagtgttgaaaacgcccattccctccaggtgagccttccccattgtggattagtgttgtggcttcatggccctaataggggtgtgtctgccaggaactgcactgcatggggcccacagccctgccccagaagcagctttggtctcgtttgctgagaccgcttgctgtgcctcatcaatttcaggaggaaacagtgagatgcctctagattttaaatctggtttcggagagcacctaagccctctgatggaatgactctcgtaggaacttgatgggggtaattctaagggggaagagcttgggaaccgtgagggctgttaggctgcaagaagggaatggatatgtgagaccatgtgggtttattttttgaagggtgaactggagtagctgaggattctgcagttgacgccccaggatggctttgctcagccctcccccgtagactggaggaaagcctaccgccaagggaggagaggatgcatctgtcctaggtgcagccggcctccctcttccaggttcagcaagggtccctggctgggcattttcctcgtaacctttggcagcattggctcaaatgccattgtttagattcccagatatttccccactgctttttgtgttaaggtagtttggtaaaatgccttattccaatggcctaagataatatcaagcaactcactggtttacttttctaaccagctgtggttaagacacacacggcaatgtgctatctttcacatgttggacgttaaacccagaccaactccccaaatctaatttgtttcagtaatttctgaatgcattgaccaagatattcctttcatctctggttgagtttcttccattagaaggaaggattaaaccttggataaaagatttgcagatgccccagtggttagtagaggtgaaaatggaggtttcagggaaactgctggggccttttgcctttgtcctcatccaaagcattttgtgcctctctttcttctcctctggctgaatatccactggagattgaattctccgaaactccctgtgtgggtgaagtgggaagctgtgcccaggaaggggagtaactgtgcaaagttttatgcagtcagtgccagaattggattacatcacctgggggaggcgccttcaggaccaggaaatggtacatggagctttgaggtgaaaactcatcttagaaacccacaaaaagtcattcccccagcctgacatcagggacagaccacacccatggggcagaaaccgggcttggttgttgcagtgggaagagaaggcacgactctggtgcaccgagcacctttcctcgtggctgtttccaggcactgggctggatgtcctcagaaccccctgtcccctgcccactcctcaaacccttactgacccacccctctcgcctggtgctgtcccaggccctgggggtgagggggaggggactccagcgtgggcttgccctccagtgtggtgggagggaaccacgtggccacttggcttagccgtgctcatggtgcagacgtggaacgcggaggcagggagaggctccgtgacgtccccagggccccagaacgaggaaggagcggagttgggattccagcccagttggacgctgaagtccctgttttgtttactgcctcctgttcatggcgtatgaatgtatctgagatgctttgtaaggcataaagtgcaatactagcttagtggctgttcgttcagtgattccttctgttaccaaacaggtggctgagatgagagggcaacccaagcctaacgcccttcagtggccttgcatcagagtactcgtgacaggtacctctccgtggagaggggctgtcctctgcccttgcctgctcctcctattgcaacagtcctgtggactagctcaggctctacaggggctgnnnnnnnnnnnnnnnnnnnnngtgtatatgtgtctacctacacacaagcacatgtgcacacatgcacacacatgcagtgcatagcacacgcacactacacacatgcacacacactcacatggacacacactatacacacacatgcacacacatacatgcacacacatgcacatggacacacatacatgcacacacatacatgcaggtgtgcagacttggctccaggcgtgtgtttgatagtattattctatgatatttccctcatctccatagaataccagcttctgaatcctcaatcagcctttactgcaagaagaaaagaaaaacctctctcattccaggtctgtggtgcagatgggaagagtatagtcaaaacccattaaggccttagtcaaatgccagccgaattagaacgcaatgaacgttagacaaaacaacccaactggccaggcgggggaggcgcagagcgtataaatataaagttagatacttataaagaataaagactctaataaaatattttatataaaactttt

SEQ ID NO: 86 - protein, 78 aa, Homo sapiens
  Unsure 52-58: Unknown amino acid
MRGQPKPNALQWPCIRVLVTGTSPWRGAVLCPCLLLLLQQSCGLAQALQGLXXXXXXXVYMCLPTHKHMCTHAHTCSA

SEQ ID NO: 87 - DNA, 2905 bp, Homo sapiens
cggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtctgcaggaaccccgaacagttccccctggtgcagggagtggccataggtggctcctatggacggaaaacagtcttaagaggcaactccgatggtacccttgtccttttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggtccaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctcggcatcttctggaaggtcaattacaactttgaagatgagaccgtgaggaagtttctactgagccagttgcagaaaaccaggcctgtgatcttggacccaggcgaacccacaggtgacgtgggtggaggggaccgttggtgttggcatcttctggacaaagaagcaaaggttaggttatcctctccctgcttcaaggatgggactggaaacccaataccaccttggaaagtgccgacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgccttcttggacttcttgaaatcaatcaagactgcaaaccctttcataaagctgccttgctgaactcctctctgcaggagccctgcttaaaatagttgatgtcatcactttatgtgcatcttatttctgtcaacttgtatttttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccaggccaaccctttcattagaacttcaagctctccaaaggctcagattataactgttgtcatatttatatgaggctgttgtcttttccttctgagcctgcctttatccccccacccaggagtatcctcttgccaaagcaaaagactttttccttggctttagccttaaagatacttgaaggtctaggtgctttaacctcacataccctcacttaaacttttatcactgttgcatataccagttgtgatacaataaagaatgtatctgg

SEQ ID NO: 88 - protein, 727 aa, Homo sapiens
MGNGESQLSSVPAQKLGWFIQEYLKPYEECQTLIDEMVNTICDVCRNPEQFPLVQGVAIGGSYGRKTVLRGNSDGTLVLFFSDLKQFQDQKRSQRDILDKTGDKLKFCLFTKWLKNNFEIQKSLDGSTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLGIFWKVNYNFEDETVRKFLLSQLQKTRPVILDPGEPTGDVGGGDRWCWHLLDKEAKVRLSSPCFKDGTGNPIPPWKVPTMQTPGSCGARIHPIVNEMFSSRSHRILNNNSKRNFWRSSGNRF

SEQ ID NO: 89 - DNA, 2618 bp, Homo sapiens
tgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttgcatcactgccttctgttcccgggggagcatggatcttttgtcctcactgctttctaatggggagggctgagggctccctgtccccacagcaggtatgtttgctctgccccagccccacacttgctctgaaaaccaagtgtcagagccccttccccttgtttttattttactgttataataattattaacttccttgtaatagaaataaagtttgtacttggagttcagctc

SEQ ID NO: 90 - protein, 582 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 91 - DNA, 2077 bp, Homo sapiens; identical to SEQ ID NO: 68

SEQ ID NO: 92 - protein, 318 aa, Homo sapiens; identical to SEQ ID NO: 69

SEQ ID NO: 93 - DNA, 12565 bp, Homo sapiens
gtcgacctgcaggtcaacggatctgagaggagagtagcttcttgtagataacagttggattatataccatgtcctgatccccttcatcatccaggagagcagaggtggtcaccctgatagcagcaagcctgggggctgcagcttggtgggtagaggtactcaggggtacagatgtctccaaacctgtcctgctgccttagggagcttctaataagttgatggatttggttaaaattaacttggctacttggcaggactgggtcagtgaggaccaacaaaaagaagacatcagattataccctgggggtttgtatttcttgtgtttctttctcttctttgtactaaaatatttacccatgactgggaaagagcaactggagtctttgtagcattatcttagcaaaaatttacaaagtttggaaaacaatattgcccatattgtgtggtgtgtcctgtgacactcaggattcaagtgttggccgaagccactaaatgtgagatgaagccattacaaggcagtgtgcacatctgtccacccaagctggatgccaacatttcacaaatagtgcttgcgtgacacaaatgcagttccaggaggcccaaatgaaaatgtttgtactgaaatttgttaaagcttcccgacaaactagatttatcagtaaggattgttttctgcaagggggatgaaacttgtggggtgagccatttgggctgaggaggagggaggttggagctgagaaatgtggagacaatttccctttagaaggactgaatctccctgcctctctggggtgcggcagccagcaggatccaatggtgtatatgtctccccagctccccattcagtgatatcatgtcagtagcttgaaattatccgtggtgggagtattatgtcatggaaattggcaaatggaaacttttattggagattcaattgttaaacttttaccagcacaacactgccctgccttcagagtcaatgaccctatccaagtttaatccatctgtccactgtctccaacacgatctttataaaacacacctgacaacattacccttttattcagttttttaaaagataagtttccagctcatcggggtggctttaaaggccatttctcctctggacctcacccaacttttcaaatcacttttcctacccctacctctaaatgctactcaaactccagccatcctgaataataagacttttgaaaagtagattatgggctgggcacagtggctcacacctgtaatcccagcactttgggaggccaagatgggtggatcacctgaggtcgggagttcgagaccagcctgactaacatagtgaaaccctgtctctactaaaaatacaaaattagttgggggtggtggcacaagcctgtaatcccagctactcaggaggttgaggcaggggaattgcttgaacctgggaggcggaggttgcggtgagcctagattgctccactgcactccagcctgggcaacaagagcgaaactccatctcaaaaaaataaataaataaataaagtagattacatcagatacctctggcctaggttgtttatgaccaactctcctgctgagaataactagaaaagctagacaaaacatatttccaaaagatctctttggaggcatcagagaatggccaaggctgtaaggaactgcctgagcccagagaggtggagcccagcactggtgccctttactcctggggacatgtgctggtttcaaaaacttcagctgagcttttgagcattcatggaacttggtgggggagatgaaatttgtaccttaaatcctgcctacagggagggtccctgataatccccacccaatttggaaatctgggtcagccttcacaggtactgaagccctcctctgaatgatctcaagtcctgctagggtagaggttacctgcttttgaaaggctcctggcctacctgtgcagcaggagcaaaagtgaaccatctcagggtacagataacaatcatccagagccttgaatgacctctactgtgcttaatatatagtattcagcagtcagtaaaaaggatttaggcacatgcaagatgacctgtgtatcagggagaaataggcaataaattgagatccagcagggatttgaatcatggatttgaatcaggggcagccttcgaaagaactatggagaatatactcagatttaaaacataagattggaatttttggcagagaactaacaactgtacaaaaaaggaaccaaatggaaatcctagaactgaaagatgcaattaaccgatgttgagaaatagccaacatctattgaacacttcccatgtggacagctgtgctaaacactttacaggcatcaacataagatgtgtccccttacagcagtgcagtgtccctcctaagacatggacagcctggtttccctatctctctgcttcatcaaaacccctttacgtggggcttagacactcctgttgtctctagtgtctagtagcacagggctcagcacatggaagccactagatacaatttgatgaccaggacctccgatgaaagccatgggtgctgattgggaaggcattgtcttttatgtgctatggtcttaaagcttcatccaggaagcagaactcggggggtgctgaggacccagaaccgagaataagattagtcagagatttcctgtgggcagaaatcataaggacgccaactgtttgggtgagataagacgaaaccaagagtggacttgtggccagaagcgtgaggaagagggagagagcttcccttgtcccctttcttcctctccctaagccacagtgattgacagcccccccgctttggagtcagagcaggcttgagactggactgggaaaggagggtgggtcaggatacagagcaggaaggctgggagtgcagggcaggagcaaggggctggggcattcattgtgcctgatctctcccactttacctggggtaaagaagcatatgcaaaagccacggtgtgagtatttcccaagtgccagggtcagggcatgattcatcacgtgcagcatttcattcaatccttatagtaaccgatgatgtggcttctattattagctctatcagataatgaaactgagaccaagacaggctctgcacattgtgtggggtaatgacacagggggattcagacctagactccataactcctgccccagggaccacccccaccctcaccctgtgcatgtcgacaaaggacagactgggccacttctcaggacacagcggggaaatgacacagagcagggaggttccaggagccccgagcgtcttttctccaggagaatactctctgaattcagactggggtcagagaaacatttacccaggagccgcagtgtgggtggggctttttacttgaaacgctgtctgaaggcagtggcaggatgaactctccaccctaccttggcaagccacttctcttctgcaatctgtaaggacattgttgagagaattatggtcttccaattccggagggttgaagaaagacaaataggagagaacctatcatagtcaggtgctagctgccttctctttcagagagtgtgagaataaagtgatacacttgattattagcaaatactttggaaattttaaacgctaatattcaacacactctggaagaggcaaataagtagacaggttcatatacatcatctccttcagctagtcctcacaaaaacaaacaaatgaataaacaaaattcttctttggccctcataggaagacactgtttcttgaacgtgtttcaaaaaggatgggtgactcactcaaggtcacactgtttatgaggacagtacaggaatacagacatgccattttgcctgaaaaaatccatcacccagggaggtgacacaattttgcagaaatgttctatttcctctgaaggatacattctttaaacctttgggaaattcattcatagtcttcctcctttgaaggattactctctggacacaaagtgtttgattctgatttgttggttggaagatgtgttggttgagagaaagattctgatttgttggttgaaaatagactcatcaagatcaactgctgtagtagtaaatattttgacattttgtctgtattcctgtgctgccctcacaagctgcatcaccttgagtgagtcattcatacttttttgtttgtttttgttttggagatggagtcttactctgttgcctaggctggagtgcggtggcgtgatcttggctcactgcgacctccatctcctgggttcaagtgatcctcctgcctcagcctcccgagtagctgggattacaggcacatgccaccatccctgctaatttttgcattttcagtagagacggagtttcaccatgttggtcaggttggtcttgaactcctgacctcaggtgatccgcccacctcagcctccccaagtgctgggattacaggtgtgagccaccgtgcccagcccagccatcatttttgaaacacgtttgagaaatagtgtcttcctttgagggccaaggagacattttttttgtttatttgtttgtttttgtgaggactagctgaagggggtgatgtatattaacctgcctacttatttgcctcttcccagagtgtgatgaatattagggtttaaagtttctgaagcatttgttaataaagcccggggctggaggtcagaagacctggatttctctgcatacttttgccatcagcaagctgtgtgaccttggacagatcccttttttgtctaaatctttctgagtcttcttgaaaacaatgccaggttgggacaggatgattgccaagctcccgtccagctctaaaacactgcaacgtatgcttctgcaccagcactgtccatcctgtagatcatgcagaaattctcttcaactttttcctacccataaaataggagcatgcttacctttttcctaatgttccaggccccgggtctagatattgtaagtaaggaagttaatgtgtatcagagcccattatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagaggttgaatttagacccattcctgtccaaatgctgagtttatgtcatcgtcccgagaccataactttaaagatgtaagatagtgggaaaagagttgatttcaaagcacctctcagaaggactcactttacatcaggggtcagcagactcaggccaaatccggtccattccccgcttttgcaaagaaagttgtagtggaacacagctaggcttattgatttatggattgccaacgtccttttgtgaaacagacagctgagctgagtaatcgtggcgcacaaaacctaaaatatttactatctcgtcctttacagaatgtttgccaatctatggtccggagtccaaggctgtccatttttcaaagaacacaaagtgacatgagactgtcccatgtgcagggagccctatcattttattatgaaaaaacggcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgggtgagtgactatttctttataaaccacaactctgggcccgcaatggcagtccactgcttgctgcagtcacagaatggaaatctgcagaggcctccgcagtcacctaatcactctcctcctcttcctgttccattcagagacgatctgccgaccctctgggagaaaatccagcaagatgcaagccttcaggtaaggctaccccaaggaggagaaggtgagggtggatcagctggagactggaaacatatcacagctgccagggctgccaggccagagggcctgagaactgggtttgggctggagaggatgtccattattcaagaaagaggctgttacatgcatgggcttcaggacttgtgtttcaaaatatcccagatgtggatagtgcgaccggagggctgtcttactttcccagagactcaggaacccagtgagtaatagatgcatgccaaggagtgggactgcgattcaggcctagttgaatgtgctgacagagaagcagagaggggcaccaggggcacagcccgaaggcccagactgatatgggcaaggcctgtctgtgctgacatgtcggagggtcccactctccagggaccttggtttccccgtctgtgacatctgtgacatgagagtcacgataactccttgtgtgccttacagggttgttgtgaaaattaaatgcacagataatagcgtaacagtattccgtgcattgtaaagagcctgaaaaccattatgatttgaaaatggaatcggctttgtgagaccatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagcacctgatgaggtgggtacagttagccacacttcacaggtgaagaggtgaggcacaggtcccaggtcaggctggccggagctctgtttattacgtctcacagctttgagtcctgctctcaaccagagaggccctttaccaagaagaaaggattgggacccagaatcaggtcactggctgaggtagagaggaagccgggttgttcccaagggtagctgctcctgcaggactctgagcaggtcaccagctaatggaggaaaggctctagggaaagacccttctggtctcagactcagagcgagttagctgcaaggtgttccgtctcttgaaacttctacctaggtgctatggtagccactagtctcaggtggctatttaaatttatacttaaatgaatgaaaatagaagaaaatttaaaatccagacccttggtcacactatccacatttaaagaggtcaatagccacatgtggttagtggccaccctattgggcagtgcagctacagaacatttttgcatcccagaaagttcttttggatgttgctgctctacagcatgctttgctgaaacagaagtgccttccctgggaatctcagatgggaagcaagtaaggaggggagtcaaatgtgggctcactgctcaccagctgtgagggttgggcctgcctcttaaccattgtcagcctcagtcttctcatccatgcatgccgtgggtatactaaaatactatacccctggaagagctggatgcaaatttgacaagttctgggggacacaggaaggtgccaagcacaaggctgggcacatggtggctgtgcactacagctgagtccttttccttttcagaatctgggatgttaaccagaagaccttctatctgaggaacaaccaactagttgctggatacttgcaaggaccaaatgtcaatttagaaggtgagtggttgccaggaaagccaatgtatctgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggtagcctgaagagggtgtggagaggtagagtctaggtcagaggtcagtgcctataggcaagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatatctggtccacacattaacagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctggtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctatttacctgcagaccaggaagatgagacctctctgcccttctgacctcgggattttagttttgtggggaccaggggagatagaaaaatacccggggtctcttcattattgctgcttcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggtaaaaacatgctttggatctcaaatcaccccaaaacccagtggcttgaaacaaccaaaattttttcttatgattctgtgggttgaccaggattagctgggtagttctgttccatgtggtggaacatgctggggtcactttggaagctgcattcagcagagtgccaggcttgcgctgggcatccaaggtggtccctcatcctccaggctctctttccatgtgatctctcagtgtttaagagttagttggagcttccttacagcatggcggctgacttccaaaagggattattccaaaaagagcctcaacatgcaggcgcttattatgacttctgcttgcatcatcctattggccaaagccagtcacgtggctaagtctagccccctgtgagaggagactgcataagagtgtgaacaccaggagacacggtcactgggggccaccactgtaaccatctaccacaggacctgaatctctgtgtgctactcccttgctcaagggcccccctacccacgcagacctgctgtcttctagcaaagcccatcctcaggacctttctcttccaatccttattgactcaaattgattagttggtgctccacccagagccctgtgctcctttatctcatgtaatgttaatgggtttcccagccctgggaaaacatggctttgtctcaggggcttgctggatgcaaccttaacctcaatgtgagtggccatactgtggcactgtcccatccctcaccagggacactgttctggagggtgactgcctgttctgtgaggagtggggatggctaggacattgcatggaacacaccaccaccccatcttctcagagctcaaaccctgacagaacaccagctccacaggccttggcttctgctgatggtgccgtgtatttaccagacttagtggtccaaggccagagtggcagatttcccaaagtcaaggtgtgacagtgggacagcctctttgtgtctttgctgtcctaagaaacctgggccaggccaggcgcagtggctcacgccttgtaatcccagcactttgagaggccaaggtgggcagatcacgaggtcaggagtttgagaccagcctggccaacattggtgaaaccctgtctctattaaaaatagaaaacattagacaggtgtggtggtgcatgcctgtaatcccagctactcaggaggctgaggcaggagaatcgcttgaacccaggaggtggaggttgcagtgagccgagattgtgccactgcactccagcctaggcgacagagcaagactccgtctcgggaaaattaattaataaataaataaacctaggtcccagagtcccacagaatggcagacaggagcacctgggggcttttagggtatggcatttcccctgtactaactctgggctgtccagaggcgatttcatggcgtggagtggagagggaggcagcacaggacttcctaggcctcagctctcacctgcccatcttttgatttccaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctccccaccaggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctatattgttgactatgtccttggccttgacaggctttgggtatagagtgctgaggaaactgaaagaccaatgtgtyttycttaccccagaggctggcgcctggcctcttctctgagagttcttttcttccttcagcctcactctccctggataacatgagagcaaatctctctgcgggg

SEQ ID NO: 94 - DNA, 3230 bp, Homo sapiens
ggtggaggacgcggctgcttcaagtccttggctctgatccaggccacagattccaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttaaaaaaaaaaaaaaaaaaaaaaaaaaaaaaa

SEQ ID NO: 95 - protein, 488 aa, Homo sapiens
MTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 96 - DNA, 638 bp, Homo sapiens
actcacaggacaaccaccacaggcaccaccacactccttgtaccccttgcccttctcccagctcattgctccaggagagagaagagttcaaaaaataaagtaatcataaacttgaactctctccattctcttgttcccatttacaggtgaatctcttcctttaagccatttttgtctcctgtgaatacagccttatctccacctgtttcttagatcccatctcccctggcttattttttccattcattaccctctttgttccctttacttctcaacctgtgctatatacatgctgttctctctgttgagattgccttatttccatctaacattctctctcctgctattctgatttgtcattcacaactgatttcaagagtcaccttcaccaggaagtcttccttgaccaccatcattcctgcctgattagagggcttcctcatggtaatatgtgttctcaagttttcagtgtcaaggaatgccatcccagaagctcattctcagatgcacaacagccagaacagtctcaagcagcattctagagcttggaatttaagaactacgcattgcctataaagtgaaacataggctaatatagattaaattgaatattgaataaaaaatatatttatttatcc

SEQ ID NO: 97 - protein, 49 aa, Homo sapiens [sequence omitted]

SEQ ID NO: 98 - DNA, 1940 bp, Homo sapiens
acccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgacagccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacgagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggcc

SEQ ID NO: 99 - protein, 516 aa, Homo sapiens
MPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDEGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFRELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 100 - DNA, 4973 bp, Homo sapiens
aggtgcgagtccccactgctggggaggcggcgggccccggctcccctcggccgcctagcccgcctcgcccgcccggggttggcggggagggaacagctgggcggccccagagcccctcggaggacaatgcgcccggcgctcggccaccctcgctcggtctcctccgcgtccggttccttcccgccgcccccggcagccgcccggctgcagcccctcttcctccgcgggggctccttccgcggccggagaggctccggcgacagcagcaccagcaccagcaccagccgcgggggaggcggcggcagacgcggcgggggcggcggctccccgagcagcagcacgggcgccgagcgcgaggacgacgacgagagcctcagcgtcagcaagccgctggtgcccaacgccgcgctcctggggccgccggctcaggtgggcgcccccgccggccccgcgcctgtcgccttctcctcctcagcggccacctcctcctccacctccacgcccacctcctcctgcagcatgacagccgcggacttcggcgggggcgccgcggccggggccgtcgggggccccgggagccgctcggcggggggcgcgggcggcaccgggaccggcagcggcgcctcctgctgcccgtgttgctgctgctgcggctgcccagaccgccccggccgcagaggtcggcgccgcggctgcgcccccagtcccaggtgccgctggggctaccaggcgctgtccgtggtgctgctgctggcgcagggcggcctgctggacctgtacctcatcgccgtcaccgacctgtactggtgctcctggatcgccactgacctggtggtggtggtgggctgggccatcttcttcgccaagaacagccggggccgtcggggcggcgcagccagcggcgcgcacaaccaccacctgcaccaccaccacgccgcgccgcccctgcatctgcccgccccctcggccgctaccgctggggccaaggcacgcggagcccgcgggggcgccggcggcgcggggggcggcctgggggcggccgcggcagcgggcgagttcgccttcgcctacctggcctggcttatctactccatcgccttcactcccaaggtggtgctgatcctgggcacgtccatcctagacctcatcgagctacgcgcgcccttcggcaccacgggcttccgtctcaccatggcgctgtcggtgcccctgctctacagcttggtgcgggccatcagcgaggcgggcgcgcccccgggatcggcaggacccctgctgctgcagccccagcggcaccgcgcggccggatgcttcctgggcacgtgcttggacctgctcgacagcttcacgctggtggagctgatgctggagggccgcgtgccgctgcccgcgcacctgcgctacctgcttatcgccgtctacttcctcaccctcgcctcgccggtgctctggctctacgagctcaacgccgcggccgcagcggctgcatcctggggccaggcctccgggcctggcagctgcagccgccttctgcgcctgctgggcggctgcctggtggacgtgcccttgctggcgctgcgctgcctcctggtggtcagctaccagcagcccctctccatcttcatgctcaagaacctcttcttcctcggctgccggggcctggaggccctggagggctgctgggaccggggcaatcgggcctccccgagtcgggccagagggggctacggtgctccgccctccgcccctccaccacctccgccaccacctcagggaggctcccagctgggccactgcatctcggagaacgaggggggtgctcatggctatgtcaacaccctggctgtggcctctcagaattgagggtgaagggcacgggtccttgtttttgggttgagagtccccaacccccttgtcttctaccttctgtcacctagatttgatcagggtctatttggaagaggtaacccttttcagggctaagggccagggtgtccttctgcaccctggggtgaggacggcttggagggagaccagcagttaacggtgagggaggtaggtgcacttaccctctcctctcttctcctatcctaccccaatcctgacctccaaggggctggtacctctgcttcttgctttgcccacctccactctaattcccatccattaggaggagaggggtgctgggccttggaccttctcccttgcttagaagtgccagcctcttttaggctgtggttagtggccattgtcccatgccttgaaattgacccagaacccactttccactgatgtgtctcttggatttcttccaggtgatagatacaaagtgtatgtctctgtgtgtgtagtgttgttttctcgtgtccaccctgtggccctttgcaatgggtaggagatctggggaggccctgccccctacaccatacttatcaccaccctcctcttttctgcctggatttgtgaccatgaattcccaggaagagctgggcccctgggagctgcccaggtactccccttgaagggagaatctcacccaggatcttcctcaatactgctcctctcttctcagctcagggagaggaggggatccattctctaaggaccaaactgcaccctttcttgggtgagtgagcatttctacctccgtgctttcaacttttgttgcatcatgcactgatgctgcttgcaaaaaatgaagacaaaatactcagaagttgcatttgccatggccactggctccagctggggtttggtgccagtgttattacagggtctgcggagtatcagccattggcttggcctctctctgttcctccctctgcacctagaactcttatccttcctgtggtttggtgccgactgggtcggatctgggcttagagtaatagctttggtgggtttcctggatggatgtgaagttgggcctcccatgggcccaagggagtaggaagccccattccccacctgtccttcctctaggaagtgtagatcagaaagtgaggtggtgacctcccacctctggtctggttaagagtctcactagggccaaggcaggctgcagaactttccctcttcctctcattgagggtgatgacaagagacatccggggactgtgcacttacagtcggtgtggaatgtcactcttgcagtctttgaggcaggataagtatttttacatattttaagggtgcaggaggacagcagctaacaaggccaggaaatactcacttccctccaccctcaacaggatgtggtgggggtgaaacttgaagaatttttgtttccccttctcccttcttacgtttgggaagttttatgtagtgtaacaaactctagacgagttaccagaagatgtggattctagttctgattctgtcactcattggctttgagtgacatatttttatttcctgggcctgttttctcacattaaaaaagtagaagttagatgagtgatctctaaggttgaaggtaatttcagctctcacattcttttgagtttgtggctcttgaaagccctggtcctgatgctccctgtaaaggtggctgggagagaagccagccaggctgcacttgcagaacattccctgctctgtactgggtgtgtgaagccccagcagagaaggccggagggagggcttgggtgcctgggctgggtgtggggcagggcctggcacagctgcagagtgcacagggagggtcagaagtgccaagtcactggccgttaactcagcacccaggccaagcccccgcctcccacttgaagccccctcttacaactgttttgggggcttggagcagaagacacccttgtagacagacataagaggggcagaaggcttgaccagagttctcttgagcctcctcatgctctcagagcagggaacagcggggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatgcccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaaccagactctgttctgaaaataaaaaacttgagacttgaaaaaaaaaaaaaaaaaa

SEQ ID NO: 101 - protein, 578 aa, Homo sapiens
MRPALGHPRSVSSASGSFPPPPAAARLQPLFLRGGSFRGRRGSGDSSTSTSTSRGGGGGRRGGGGGSPSSSTGAEREDDDESLSVSKPLVPNAALLGPPAQVGAPAGPAPVAFSSSAATSSSTSTPTSSCSMTAADFGGGAAAGAVGGPGSRSAGGAGGTGTGSGASCCPCCCCCGCPDRPGRRGRRRGCAPSPRCRWGYQALSVVLLLAQGGLLDLYLIAVTDLYWCSWIATDLVVVVGWAIFFAKNSRGRRGGAASGAHNHHLHHHHAAPPLHLPAPSAATAGAKARGARGGAGGAGGGLGAAAAAGEFAFAYLAWLIYSIAFTPKVVLILGTSILDLIELRAPFGTTGFRLTMALSVPLLYSLVRAISEAGAPPGSAGPLLLQPQRHRAAGCFLGTCLDLLDSFTLVELMLEGRVPLPAHLRYLLIAVYFLTLASPVLWLYELNAAAAAAASWGQASGPGSCSRLLRLLGGCLVDVPLLALRCLLVVSYQQPLSIFMLKNLFFLGCRGLEALEGCWDRGNRASPSRARGGYGAPPSAPPPPPPPPQGGSQLGHCISENEGGAHGYVNTLAVASQN

SEQ ID NO: 102 - DNA, 1820 bp, Homo sapiens; identical to SEQ ID NO: 56

SEQ ID NO: 103 - protein, 514 aa, Homo sapiens; identical to SEQ ID NO: 57

SEQ ID NO: 104 - DNA, 2485 bp, Homo sapiens
tttcttccaaggaacaaaggcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttggcacaaagtggagtcaatcttttaatgttttaaatatgcattttcagactcaaataattaagaagtttcattgatatccactggtcacatcataactgtctatagggcaataaaatctgtgttaaactc

SEQ ID NO: 105 - protein, 695 aa, Homo sapiens
MIMKSNFDETYIENVVRNILKGQDVDSKEAQLISFLALLSSYVTDSTISVSQCEIFLGIIYTSTPWEPESLEDKMGTYSTLLIKTEVAEYGRYTGVRIIHPLIALYCLKELERSYHLDKCQIALNILEENLFYDSGIGRDKFQHDVQTLLLTRQRKVYGDETDTLFSPLMEALQNKDIEKVLSAGSRRFPQNAFICQALARHFYIKEKDFNTALDWARQAKMKAPKNSYISDTLGQVYKSEIKWWLDGNKNCRSITVNDLTHLLEAAEKASRAFKESQRQTDSKNYETENWSPQKSQRRYDMYNTACFLGEIEVGLYTIQILQLTPFFHKENELSKKHMVQFLSGKWTIPPDPRNECYLALSKFTSHLKNLQSDLKRCFDFFIDYMVLLKMRYTQKEIAEIMLSKKVSRCFRKYTELFCHLDPCLLQSKESQLLQEENCRKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 106 - DNA, 781 bp, Homo sapiens
gttacagcaaccctagacatgaggtactagacacagtacatctacacatatgaaaatgaatcaacacagaatgcagaagtagaacccttgctaaggactactgggcatcttcccaggacagcagccaaaagagaaccaccacttcctctcctgcctcctccttgctctctcctagagtccaaacccaaatgggccagttggatctgatgttcgtcagttctttacttctatttcctggggtactcaggagggcacacactatagataacttgggttagctgcataaaattcaatgtctcattaagttgcattaaactgagcttagatgtgtaagtttgctaacggatgggtttttttgttaagaactataggatttatgggaccaagtctagcgagtccagatatcaaaatcattataatgttatatttgctgttattagaatataatatagcttattatacaataaatatgtagactgtaaaatatatttctcactagtacctcctattttctttctctgttgaagtttttaaatcccacagataattaaattggcacctttatgcttgttcaaaaattaaaataatctattaaataagttcaaattaaagatttttacttcaaatgactgatttgtgatttgcttttaatttcttaaaatgttaccacataattcatctaaagtataaaaaggaatagcaaattttagatgttgtgcagatatataatgcttgtgtcagaattattataatattgataataaactttagatattgcttc

SEQ ID NO: 107 - protein, 16 aa, Homo sapiens
YSNPRHEVLDTVHLHI

SEQ ID NO: 108 - DNA, 1948 bp, Homo sapiens
ggagaccggaggtctgagctgcagccactacacaggcctggaattctaccacagggaatttgcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctggcccaggcatcctaggggctgaaatcctggaaaccgtgggctggtgtgagaaggtttgcatgctcagagcagagaagggctctccccactgcttcgtgattccagggccagagccatgcagtcccagaaaccccaacctagctggggcaggtccagagtccaagccctggtgggtagaggccaagcagaagccctgaagtggactcttgcttcccctagtagtgttttcagtgccaagaagctgaaactgtgagctggagttggggagaggtctggaagaggaccatctgggatttctacagcctgggtacccatagccacaccaaggcttctgggagattctgcagggtcagctttccaggctgttcccaaatagctccctgcctccccactgcccctaaagccacagcagaagagccattcatctcataaacaaaaaggaagaggaaagaatgaggaaggaccctgtgcaaggttatttgcaggcagggatgggcttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatctttaaaaaaaaaaaaaaaaaa

SEQ ID NO: 109 - protein, 189 aa, Homo sapiens
MDCASCSAPGLLGCWDQAEGLLGPGPQGQHGCREQLELFQTPGSCYPAQPLSPGPQPHDSPSLLQCPLPSLSLGPAVVAEPPVQLSPSPLLFASHTGSSLQGSSSKLSALQPSLTAQTAPPQPLELEHPTRGKLGSSPDNPSSALGLARLQSREHKPALSAATWQGLVVDPSPHPLLAFPLLSSAQVHF

SEQ ID NO: 110 - DNA, 841 bp, Homo sapiens
gaaccgtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtgagaatgcgggtaaggatgcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaa

SEQ ID NO: 111 - protein, 138 aa, Homo sapiens
MRQKAVSLFLCYLLLFTCSGVEAGENAGKDAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 112 - DNA, 1326 bp, Homo sapiens
atggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcggagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtctcgccacagcaatcaggcaagagaaagaagtaaaaggcaccc

SEQ ID NO: 113 - protein, 317 aa, Homo sapiens
MEGDFSVCRNCKRHVVSANFTLHEAYCLRFLVLCPECEEPVPKETMEEHCKLEHQQVGCTMCQQSMQKSSLEFHKANECQERPVECKFCKLDMQLSKLELHESYCGSRTELCQGCGQFIMHRMLAQHRDVCRSEQAQLGKGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKRKTSEKFQLDLEKERYYKFKRFHF

SEQ ID NO: 114 - DNA, 5801 bp, Homo sapiens
caggcaaggcttatctggtgaaaacttttttgctatgctcagagggtaccgagtagaaaattatgacccaaaagggaccattgctttgtggtcataattttctactcggtaccctctgagcatagcaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacactacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccgccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataag

SEQ ID NO: 115 - protein, 1514 aa, Homo sapiens
FSTRYPLSIANYDHKAMVPFGFPEFFRCDPAISPSLHAAAQISRGEFVRISGLDYVDSALLMGRDRDKPFKRRLKSESVETSLFRKLRTVKSEHETFKFTSELEESRLERGIRPWNCQRCFAHYDVQSILFNINEAMATRANVGKRKNITTGASAASQTQMPTGQTGNCESPLGSKEDLNSKENLDADEGDGKSNDLVLSCPYFRNETGGEGDRRIALSRANSSSFSSGESCSFESSLSSHCTNAGVSVLEVPRENQPIHREKVKRYIIEHIDLGAYYYRKFFYGKEHQNYFGIDENLGPVAVSIRREKVEDAKEKEGSQFNYRVAFRTSELTTLRGAILEDAIPSTARHGTARGLPLKEVLEYVIPELSIQCLRQASNSPKVSEQLLKLDEQGLSFQHKIGILYCKAGQSTEEEMYNNETAGPAFEEFLDLLGQRVRLKGFSKYRAQLDNKTDSTGTHSLYTTYKDYELMFHVSTLLPYMPNNRQQLLRKRHIGNDIVTIVFQEPGALPFTPKSIRSHFQHVFVIVKVHNPCTENVCYSVGVSRSKDVPPFGPPIPKGVTFPKSAVFRDFLLAKVINAENAAHKSEKFRAMATRTRQEYLKDLAENFVTTATVDTSVKFSFITLGAKKKEKVKPRKDAHLFSIGAIMWHVIARDFGQSADIECLLGISNEFIMLIEKDSKNVVFNCSCRDVIGWTSGLVSIKVFYERGECVLLSSVDNCAEDIREIVQRLVIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASAISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEGLDSDEELGLLCHHTSYLDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKS

SEQ ID NO: 116 - DNA, 338 bp, Homo sapiens
gcctaaaggcagggccctcatgactctatcacctaccaaaaggctccacttctttatactattggaggggtagaaggaacttcctttctagaccttgaaggtttaagaatttgaatctataaaacaagctgacaatagacagattaacaggagaaaaagcatatacattttttaatgtgggccagatggcagaagcttaaataacaccccaagctacaggaagtgaggcctctgatggggaggtagtgacacaggctgtgggagggggtagggggaggaagtctgtggtgagcaaagtttgccttattacactgataaagtgtaattacactaataaa

SEQ ID NO: 117 - protein, 23 aa, Homo sapiens
PKGRALMTLSPTKRLHFFILLEG

SEQ ID NO: 118 - DNA, 542 bp, Homo sapiens
tatgtggacttgttttcatttctcttggatgtatattcctaggagaatggctggattatacagtaactctttcctcataactttgcatatcaaaattatatccatctttcagaacccaaattcagtgttatttccaaagtgttccaacatctcccactcaaaatgaatcttctccctagtactcccattgtttagtacctaattgttcttaccagtttgtcttagagctcagtcattcctacacagcacttttcttcattatactgctaatttcattacactgtaagagtggggacaagctgttcttcttgtataccagaaagtagtgagtgcactgctgtgaagaaagcaggaactcaaaagttaagaattttgaatgagcctataaaatgtgtctaataaataataatgttcattttcaaatctcaacaattaaatgtttaacaaataacacttgaaataaatgtttattagaaaaaccaaaaaaatctatgtcggtgcggagaaagagggtaatgaaatggcaggaattcgatatcagc

SEQ ID NO: 119 - protein, 54 aa, Homo sapiens
MWTCFHFSWMYIPRRMAGLYSNSFLITLHIKIISIFQNPNSVLFPKCSNISHSK

SEQ ID NO: 120 - DNA, 1204 bp, Homo sapiens
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaatacca

SEQ ID NO: 121 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 122 - DNA, 376 bp, Homo sapiens
ttaatatacaatttttatttgtcaattagaaagtaacaataaagagtgagcttataagttatggagttaaaattttatgcagaagcaagggaaaatcttcctccagtgaaaaaattctaatgagattttgaagacagaaacaaatcacattttttttgtttttgttttctaaatgttttacaagagaaaatttcaaaagcataatcagtaagagggagaaaagtgtgctgaattccatgtatccagcttgcagccattgttaactcaggactaatcttgtttcggttctacttccctttcaccacccccacaccccaaacacaaaattactgattctagatcatgtcatttatttacaaatactttagtatgtatc

SEQ ID NO: 123 - DNA, 1527 bp, Homo sapiens
ctctacaagtacttctatgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtgccgctgcaggttcctttggcaactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattgagtgtaactgcaaccagataggctccgtgcacgaccggtgcaacgagaccggcttctgcgagtgccgcgagggcgcggcgggccccaagtgcgacgactgcctccccacgcactactggcgccagggctgctaccccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgccaaaaaaaaaaaaaaaaaaaaaa

SEQ ID NO: 124 - DNA, 2619 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctacagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcatgcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgctgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggctcccctgctgaaggtggggattgcccatccatctgcttacaattccctgctgtcgtcttagcaagaagtaaaatgagaaattttgttgatattcaaaaaaaa

SEQ ID NO: 125 - protein, 711 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPTGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTACKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 126 - DNA, 2224 bp, Homo sapiens; identical to SEQ ID NO: 77

SEQ ID NO: 127 - protein, 429 aa, Homo sapiens; identical to SEQ ID NO: 78

SEQ ID NO: 128 - DNA, 1081 bp, Homo sapiens
gaccgctgacctagagggagttatgcacatgggcttataaggttagccaagagaaaggacaagaagacccaaagtcggcaagcaaatttattaacctgctgggctgctctacagaaatctgaggaggcagacaccgggcttacaggctaaggggtataagtaggtctgcaggggttttgtgtgtgtgtgcgggggtgtcgggggggcaaggccatttgtggagacttttcctcccagtatggccacatcctgcagtttgtcagtttttgcccccgcctggctcagggtaccaggatgtggtttagcttaggggtggttatagtggcacctaagttctgggaacttgcggtgggggcgaccttttggacgaaaaataagctgcagggcagctaggggagggggcttgttatattcctctgggggcagggtgtccctaactgggctcagtcggaaggaacttgaccaaagtctgggctcagttgggcatcactcaggctaatggtcgtgtgctggatgccatcagagggaagtaccaatggtaaagtggaaacaatgtgcagctttcaactgggtggaggctgctattctgtggacagtgagatgtttccttggcactgtcaatagacaatctgcgtagagaaattccaagctgaaagccaataatgttataataaaatagagattcttcagaagatgaaaggaattaccagcatggaaattgtgtcataggcttaagggctaaagaagaagccttttcttttctgttcaccctcaccaagagcacaacttaaatagggcattttataacctgaacacaatttatattggacttaattattatgtgtaatatgtttataatcctttagatcttataaatatgtggtataaggaatgccatataatgtgccaaaaatctgagtgcatttaatttaatgcttgcttatagtgctaaagttaaatgatcttaattctttgcaattatatatgaaaaatgactgatttttcttaaaatatgtaacttatataaatatatctgtttgtacagattttaaccataaaaacatttttggaaaaccataaa

SEQ ID NO: 129 - protein, 12 aa, Homo sapiens
TADLEGVMHMGL

SEQ ID NO: 130 - DNA, 1121 bp, Homo sapiens
gaggcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaa

SEQ ID NO: 131 - protein, 285 aa, Homo sapiens; identical to SEQ ID NO: 121

SEQ ID NO: 132 - DNA, 1318 bp, Homo sapiens
ggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttgt

SEQ ID NO: 133 - protein, 35 aa, Homo sapiens
MGDHQKVILSHLDVTIETNWGVGCYCKIKYTVLKT

SEQ ID NO: 134 - DNA, 3211 bp, Homo sapiens
atcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaagtggtaggactcaatcaaatggtgcctcaaattgagggaaacacagggacagtccctcagcctaccaatgtgaaggtagttcttccagcagctggcctctcagctgctcagccaccagcttcctaccccttaccaggctctccccttgctgccggcgtgttacccagccagaactccagtgtgctcagcacagcagcaacttctccccagccagcgagcgcaggtatcagccaggcccaggcaactgttcctcctgcagttcctacccacaccccaggccctgccccgagcccaagccctgccttgacacacagtaccgcgcagagtgacagcacctcttacatcagtgctgtggggaacacgaacgctaatgggacagtagtgccaccgcagcagatgggctcaggtccttgtggttcttgtgggcgaaggtgcagctgtgggaccaatggaaaccttcagctaaatagttactattatcctaatccaatgcctggaccaatgtaccgagtcccttcattctttactctgccatccatttgcaatggcagctacctcaaccaagcacatcagagcaatggaaaccaacttcctttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactacgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgcttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcgaactcccaaaatagtgtgtatatatgtaataaacagcgtcacgtaaatacatatatgcagtgcttgttgtccaaatagaaatgaaaataagtggaagagagaggaagaagtcaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcgtagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacataaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacaaaaaaaaaaaaaaaaaaaaa

SEQ ID NO: 135 - DNA, 2863 bp, Homo sapiens
atctgaaaaattaataattccttaattatcaaatatccattatttaaatttataattgtgtcataaatattgtcataaatagatttgctgttttaaagcttgttccttcattttctctgttttgttttagataaacattgtcataaatagatttgttgttttaaagcttgttccttcattttctctgattgttttgttttagattcagaggttacttatgcttgtttgttacatggatgttacatgtgtaatgggggatattggacttctagtgtactcatcacccatatactgaacactgtactcaaaagggattgaaagaaactaggaaacttggcaggaagatcattcttaagccaggaaaaaaatttttaatgctcacatgtgaacatgtgatggtcataccagaaggagcacccacctccctccctctgtgacagacacattttcttagccttcacctttccttctttcaagttgctgaaaatccacagtgtttctgttcatttgttactttcattctcacctatcttctctcttgctccatctaccagaacaataattccccatataatacttctcacttcacttttcaacgcaggacctcttgttggtctgatctgtttgtctgtccgctttatcaatattatcagatgtaagtttacatgaatacacacacatattcactaaactgaggggaaaaaatgccttgtaggtcataaaaaagcagggaaattcccaacaattcatatttgatccctggatccaggggtggcagcaataagcctgctttagatatttactccccattttatgatccggtggtttggtttttcaaatgatgatatggctcctttcgcaatgacttgatgtttaggaggtgtgcttcaataaatacattttaaaatcaacaatcaagttagagttgtacaaatggctctgaaatgtcccactacactgttagaccaagggcacagattgtgcttctgtactatttatcctagtatccctcggcatatattaactgctctaaaaatctccttggctacacgctgcatcaaatcaaagttaaatgttataccacctttctattctatttttaatattcaaagagggtgctcagattttagaacaaatttcaatgtttaagtacacacaaaaaaatcattaactcatatatttcaagagtaggaaatgggaactggtgttaaaactcttataacaaatgtcactgtcttaagggacagtgtttaaaaacgcatacctggccgggcgcggtggctcatgcctgtaatcccagcactttgggaggccgaggccggcggatcacaaggaaaacaaactcaggaagaaaaaggaaagcagaagtgatcaaggagagcgctcgagttgcaatattttcctttggctgctgacaggcagttactataaagcattgtgcatggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 136 - protein, 319 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 137 - DNA, 1414 bp, Homo sapiens; identical to SEQ ID NO: 70

SEQ ID NO: 138 - protein, 277 aa, Homo sapiens
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 139 - DNA, 7484 bp, Homo sapiens
tgctcacttctgacagccagacaagggctgtgctcaggggcagctcggctgggcacacagtaggtgctttagcggacagcactgaggcccccagcaagaagcccatgagctcctccccctcccgcagtgccgccgacatctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctacgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcaacccagaccgggacatgtccatggcgtcctggctgaatctggctgagattgcgcaggtcgtcgagaaggtgcaggaggcctacaacacctggcccagctgctggggcggccgtgagcagaggtgcatctgtgtcgtttcccacggtgcccaggtcagtgcactgaggcaggagctgaggaggcgggacctaggccaggtgtctgtcggcagttttgagatcctgccagggcggcagttccgggtcgtggtgctcagcactgtgcacacctgccagagcctgctcagccctggggcactggcccctgagttcttcaccgacgcccgcgtgctcaacaccgtcctgacccgcgcccagtcccagctggtggtagtgggggacgccgtggccctctgctccttcggggcctgcggcaagctctgggagagcttcatccgtgagtgcgtggagcggcacagtgtctgccccgagggcctgtccatggagcaggtcgagcagggtgtggcgcagagacggcgctggcctccccgaggcacacaggctggggcagcggggaactgggaggctgccccagagccagtaggggacctggccgaggagcaggcggctgtggtgacggccatggtgaaggcagagccgggagatgaggctctgagcccagcatcccgtgacatcacggcaaccacagcgcagacggaggctgcggcagcaccagcaggagacgcagtgaaggaagacgtggtgcccggggcctgtgcggcaggagcggctgctgcagcgggcgtggagtccacggaggctgaggatgcagaggctgacttctggccgtgggacggggagctcaacgctgacgacgccatcctacgggagcttctggacgagagccagaaggtgatggtgaccgtcggggaggacgggctgctggacaccgtcgccaggcccgagtccctgcagcaggcccggctgtacgagaacctgcccccggctgcgctacggaagctgctgcgcgcggagcccgagcggtaccgccactgctctttcgtgccagagaccttcgagcgggcgtcagccatcccgctggacgatgcctcctcgggccccatccaggtcaggggccgcctggactgtgggatggccttcgccggggatgaggtgctggtgcagctcctttcgggagacaaggcgcccgaggggcggcttcggggccgcgtgctgggcgtgctgaagaggaagaggcacgagctggcgtttgtgtgccgcatggacacgtgggacccgcgcatcatggtccccatcaatggctccgtgaccaagatcttcgtggccgagctgaaggacccatcgcaggtccccatctacagcctccggaagggccggctgcagcgtgtggggcttgagaggctcaccgccgaggcccggcacagccggctcttctgggtccaaattgtcctgtggcggcaaggcttctactacccgctgggcatcgtccgggaggtgctgcctgaggccagcacctgggagcagggcctccgcatcctcggcctggagtacagcttgagggtgcccccgtcggaccaggccaccatcaccaaggtgctgcagaaataccacacggagcttggccgggttgccggccgccgagaggactgccgcgccttcttgaccttcactgtggacccccagggcgcctgcaacctcgatgatgccctcagtgtccgagacctgggtcccaggtgcgaggtggctgtgcacatcactgatgtggccagcttcgtgcccagggacggggtgctggacgtggaggcgcgaaggcagggcgctgcgttctatgcccccggcagggagccagtgcccatgctgccggccagcctctgccaggacgtcctcagcctcctgcctggccgggaccgcctggccatctccctgttcctcaccatggagaaggccagtggccagctgaagagcctgcgctttgcaccctccgtggtccagtctgaccgccagctgtcctacgaggaggcggaggaggtgatcaggcagcacccgggtgccggccgtgagctgccggcccgcctggactccgtggacgcctgcgtcgtggccgcgtgctacttctctcggctgctgcgccggcaccgcctgcggtccgactgcttctatgagcagccggacgaggacggcaccctgggcttccgcgcggcccacatcatggtgaaggagtacatgattcagtttaataggctcgtggctgagttcctggtgggcagcgagtgcacgcggacggtcacgcctctgcggtggcagccagcaccccgcagccagcagctcaaggccctgtgtgagaagcatggggaccgggtgcccctgtcactgcacctcggccaccacctgcacggcggcgggggcagtccccccgacacgcggctgcacctcctggcctccctctggaagcaggtccagtttgctgcccgcacccaggactacgaacagatggtggacttggtcaccacggacgacatgcacccattcctggctcctgcaggccgcgacctccgcaaggccctggagcgctcggcgttcggccgctgcgcccggggccaccagcagcagggcggccactactcgctgcaggtggactggtacacgtgggccacctcgcccatccgcaggtacctggacgtggtgttgcagcggcagatcctgctggcgctgggccatgggggctctgcctactctgccagggacatcgatgggctctgccaggccttcagcctccagcacgcacttgcccagagctatcagcggcgggcgcgcagcctgcacctggccgtgcagctcaaggcccagcctctggacaagctgggcttcgtggtggacgtggaggcgggctcccgctgcttccggctgctcttccccagcaaccgggagacgctgcctgacccctgccccgtcccctacggctccctgcagctggccgagcacccccacgccctggcaggccggccgggcctgcggctcctgtggcggcgccgtgtctactcagcgcagggatccagcccgcccctgccactgcctggcactgtgccggacccacacaccctggccgtggagacggccctgtggaagcagctgctggagctggtggagctgcagcgctggccggaggcggctgctctcatccaggagaagggcgaggcgtcccagcggcgggagctggtgcaggtgcagcggagccactgtggccatttcctggaggtggcccgggagctgggcagtggggacaccctgcaggtgcagctcggcaccagcctgcagcacggcttcctggtaccgagccctcagctctggacggtggcaccgggcttcagcctctgcctggagcacgtggagcggcccggagactgcttctcaggccgtgtgtaccgggccccgagggaccggtaccgcgacgtggatgagtacgcctgcgtgtgggaaccattctgcgccctggagtcggccaccggcgcggttgccgagaatgactccgtcacacttcagcacctgagtgtctcctgggaggcgtcacggacgccgcaggggcagctgcagggcgccttccgcctggaggccgccttcctcgaggagaactgtgccgacatcaacttcagctgctgctacctctgcatccggctcgaggggctgctggctcccacggccagcccacgccccgggcccagcagcctcggccctggcctgaatgttgaccccggcacgtatacctgggtggcccacgggcagacggaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctccgcaaggaggaagccgtgcgtggactagaggaggcgtccccgctggtcaccagcatcgcactgggccggcctgtcccgcagcccctctgcagagtgatccccagcaggttcctggagcggcagacctacaacatccccggaggccgccacaagctgaaccccagccagaacgtggcggtcagggaggctctggagaagcctttcacggtcattcagggcccaccaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgtcctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaacgtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgcttctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgat

SEQ ID NO: 140 - DNA, 3063 bp, Homo sapiens
agcggggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgagacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatggagaatagagatgtggtgcccactaggctactgctgatagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatccactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctgggggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattaataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacataaaaaaaaaaaaaaa

SEQ ID NO: 141 - protein, 460 aa, Homo sapiens
MEGENSLDDFEDKVFYRTEFQNREFKATMCNLLAYLKHLKGQNEAALECLRKAEELIQQEHADQAEIRSLVTWGNYAWVYYHMGRLSDVQIYVDKVRHVCEKFSSPYRIESPELDCEEGWTRLKCGGNQNERAKVCFEKALEKKPKNPEFTSGLAIASYRLDNWPPSQNAIDPLRQAIRLNPDNQYLKVLLALKLHKMREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEEAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGEWRIEMWCPLGYC

SEQ ID NO: 142 - DNA, 2958 bp, Homo sapiens
ggcacgagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccagacccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtagcagctgcctccaggatgagttacttgaaatttgccttgagtgtgttacctcctttccaagctcctcgtgataatgcagacttcctggagtacaaacacaggatttgtaattcctactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgt

SEQ ID NO: 143 - protein, 808 aa, Homo sapiens
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 144 - DNA, 3509 bp, Homo sapiens
ttatgctaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatatgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgccgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgaagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgcgccttttttttttttctgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccactgtgaccagccaatgtgccttcttatagtgtctactcattggtctttgttctgcccagtgataacaatgggataacgcctgctacacatcttcattgtgaaacccttcccctgtgctgagattaaatgaactctgagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagaggcctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtc

SEQ ID NO: 145 - protein, 419 aa, Homo sapiens
MKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 146 - DNA, 2010 bp, Homo sapiens
gtcgactaccagaaaatactttcaacataaatgaactctccaacttattaaacttttatatagatagaggaagacagctctttcgggataaccacctgatacctgcagaaacccccagtcctgttattttcagtgattttccatttatctttaattcgctatccaaaattaaattattgcaagctgattcacatataaagatgcagatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgtgttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaagctaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcactccaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccacccaaaaaaaaaaaaaaaaaaaaaaaaaaaaaaaaaa

SEQ ID NO: 147 - protein, 379 aa, Homo sapiens
MQMSEKKAYMLMHETILQKKDEFPPSPRFILRVRRSRLVKDALRQLSQAEATDFCKVLVVEFINEICPESGGVSSEFFHCMFEEMTKPEYGMFMYPEMCSCMWFPAKPKPEKKRYFLFGMLCGLSLFNLNVANLPFPLALYKKLLDQKPSLEDLKELSPRLGKSLQEVLDDAADDIGDALCIRFSIHWDQNDVDLIPNGISIPVDQTNKRDYVSKYIDYIFNVSVKAVYEEFQRGFYRVCEKEILRHFYPEELMTAIIGNTDYDWKQFEQNSKYEQGYQKSHPTIQLFWKAFHKLTLDEKKKFLFFLTGRDRLHARGIQKMEIVFRCPETFSERDHPTSITCHNILSLPKYSTMERMEEALQVAINNNRGFVSPMLTQS

SEQ ID NO: 148 - DNA, 2881 bp, Homo sapiens
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttccgagtttccccagaagagaatatgggattttttttgacatttttgacccatttaataatgctcttgtgtttacctagtatatgtagactttgtcttatgtgtcaaaagtcctaggaaagtggttgatgtttcttatagcaattaaaaattatttttgaactga

SEQ ID NO: 149 - protein, 592 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 150 - DNA, 6270 bp, Homo sapiens; identical to SEQ ID NO: 52

SEQ ID NO: 151 - protein, 1087 aa, Homo sapiens; identical to SEQ ID NO: 53

SEQ ID NO: 152 - DNA, 633 bp, Homo sapiens
tttacctgaaagctacgtgaatcgttggtaaattggtgtaaaaatggaactgagtcatctcaaaagttcctttcagttctaaaattctgtgaattgaagcctactttttcactttaaatgatttattgggtttacagttctttacgctttctgattgaactgatttgaagttcttatttcgtgtgttggggaacacacccccaacccgtcacagcgtggccgtgggtgggagatggacgttaggctggccagtcactagggggcagcatcagcacgggtctggctgtccctggccttagggagcagtttctgcccctcctgccccgtcagaaagtctcggactcctctctgcttgcatgtgtaaagttttcattttcaggggccttttagtcaaaaaaaataaagctgtatgatttagtgctgaaggatatgaattaggcatagctcttgggttggcagcataaaccaaggggcatcaacccaccaccaacaagctaagaatggtttttacatctttaaatggttgaaaaaggaaaaagaatgtttagtgacacgtgaaaaatacatgaaattcaaacttcaatgtctacaaataaagtgcattagcacacggtcgtcttgcttctcaaaaaa

SEQ ID NO: 153 - protein, 22 aa, Homo sapiens [sequence omitted]

SEQ ID NO: 154 - DNA, 2863 bp, Homo sapiens; identical to SEQ ID NO: 135

SEQ ID NO: 155 - protein, 319 aa, Homo sapiens; identical to SEQ ID NO: 136

SEQ ID NO: 156 - DNA, 3906 bp, Homo sapiens; identical to SEQ ID NO: 75

SEQ ID NO: 157 - protein, 482 aa, Homo sapiens; identical to SEQ ID NO: 76

SEQ ID NO: 158 - DNA, 1119 bp, Homo sapiens
ggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaacgtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggt

SEQ ID NO: 159 - protein, 279 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIERLDKLKGNKSYVNMDLSPVVECMDHALTSLFPKTHYAAGKDAKIFWIPLSHMPAALQDFLLLKQKAELANPKAV

SEQ ID NO: 160 - DNA, 490 bp, Homo sapiens
tcgaattcctaatttttgtgggactccttaagacccacaagtgacttctgtctacactacagatgaactgaattgatcatctaaaatacgtttatagcgttcattgtgccagttgctcatggttctgctaattggcccaggactagttgtgatctgcagactgaagccagagtaagtaagagaattcaaggcactaagacaaccaggaacagttttaccaaggcaagtggaagctgctaggctcagtggttgcatgcctatagatggggtaaatcatcctggtgcaaatatggtattcacaccataaatgtgtagtgcaagtttcctctgtggccaatcacagggctgcaagctgaagccccagtttagcttattctccatacataacttcaaggggactttctggtgaacttttccaagaagctccaagcacagatggttcaaatttgcagtttggctagactttgtgactggatgtacattaaattaa

SEQ ID NO: 161 - protein, 17 aa, Homo sapiens
MVQICSLARLCDWMYIK

SEQ ID NO: 162 - DNA, 2214 bp, Homo sapiens
ttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggacagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaatgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcagatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcggttaataacaggcaaaaggaagcagggttggtttcccttctttttgttcttcatctaagccttctggttttatgggtcagagttccgactgccatcttggacttgtcagcaaaaaaaaataataataataataataaggcctgctgtgtaagctgacagtatttgtagctgatagggggttgggaggaagtgtctactaggagggtgggtgagatctgtgttgatgt

SEQ ID NO: 163 - protein, 355 aa, Homo sapiens [sequence omitted]

SEQ ID NO: 164 - DNA, 2881 bp, Homo sapiens; identical to SEQ ID NO: 148

SEQ ID NO: 165 - protein, 592 aa, Homo sapiens; identical to SEQ ID NO: 149

SEQ ID NO: 166 - DNA, 1014 bp, Homo sapiens
ttcctcagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggttccggtgttcctcctgccagcgaagttgggcttccgccaagttgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcatgaggaagtctccagaaatgccagtaatcctggaagtgtccctggaaggatcccatgacacagccaattgtgaggcatgcactttgggcatatgtggacagggcttaaaaagctacatgacaaagccgtccaaatccctactcccccacctaaagactgggaattcctcacctggaattggtgctgtgtacctcgcaaaccaagccaagaaccagtcagatgaggcaaaagaggctaaggggagtgggtatgagaaattagggcccagtcgagacccagatccactgaacatctgtgtctttattttgctgcttgtatttattgtagtcaaatgctttacatcagaatgatgaaaataggcttgccactttctcttattttaattccatggtagtcaatgaactggctgccactttaatataactgaaaattcattttgagaccaagcaggatcaagtttgtagaataaacactggtttcctagctatcctctgaaaacagtatgaaacatgaccaagtacataatggatttagtaataaatattgtcgaattgctaaaaaaaaaaaaa

SEQ ID NO: 167 - protein, 246 aa, Homo sapiens
MVVDFWTWEQTFQELIQEAKPRATWTLKLDGNLQLDCLAQGWKQYQQRAFGWFRCSSCQRSWASAKLQILCHTYWEHWTSQGQVRMRLFGQRCQKCSWSQYEMPEFSSDSTMRILSNLVQHILKKYYGNGMRKSPEMPVILEVSLEGSHDTANCEACTLGICGQGLKSYMTKPSKSLLPHLKTGNSSPGIGAVYLANQAKNQSDEAKEAKGSGYEKLGPSRDPDPLNICVFILLLVFIVVKCFTSE

SEQ ID NO: 168 - DNA, 1571 bp, Homo sapiens
ctctgtcctgccagcaccgagggctcatccatccacagagcagtgcagtgggaggagacgccatgacctccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtaaggaaggagaagatgaacacccacaatgcctgaactcccattcccatgcccgtgggtcatcccgggccatcttctccgtgggccccgtgagcccaagtcgcaggtggtcgtacaggtgctatggttatgactcgcgcgctccctatgtgtggtctctacccagtgatctcctggggctcctggtcccaggtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgaa

SEQ ID NO: 169 - protein, 439 aa, Homo sapiens
MTSILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCKEGEDEHPQCLNSHSHARGSSRAIFSVGPVSPSRRWSYRCYGYDSRAPYVWSLPSDLLGLLVPGVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 170 - DNA, 566 bp, Homo sapiens
gattcgcccagtaggcatgagccaccgcgcccggtcgagggttttctcatagtatgtttagttgttctgaggagctttgtatctttgagaaatgcatgtttacaacatccacagtttcttctaaagctttcaggtgaactgcacacagttccactatgtcttctggggaaactcttgaatatcctggtacatcttcctttataaggactcatactgggcccactatgtaaaacgtggtttttcgggatattggaggttttgcaccacagagaattcaattcacttgggagtgttcatctatttaggaagtatagttttttttacttttgtcttcaggaatatgcactgctaccttttagaaataatttctattgcctttattatttttgttgttatttaatgggaaaaggttagacatggccaggtaaatgttatcaaataaagttagtattcgtattcaacaagtggaatttttactttgctgttctcagaaacccatgaatctgtgtgttctcagaaacccatgaatcattatgtatacaaattaaaaattgtaatgtactgct

SEQ ID NO: 171 - protein, 67 aa, Homo sapiens
DSPSRHEPPRPVEGFLIVCLVVLRSFVSLRNACLQHPQFLLKLSGELHTVPLCLLGKLLNILVHLPL

SEQ ID NO: 172 - DNA, 3258 bp, Homo sapiens
gccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagcctcgggcgaggccgtccggccgcacccctcctgctcagctgcggtcgccatggccaatgacagctgcgggcccggcgagccgagctcgagcgagcgagaccggcagtactgcgagctgtgcgggaagatggagaacctgctgcgctgcagccgcagctccttctgctgcaaggagcgccagcgccaggactggaagaagcacaagctcgtgtgccagggcagcgagggcgccctcggccacggagggggccctcaccaggactccggccccgcgccgcccgctgcagcgccgccgtccagggaccgggccctggaggccaggaaggcagcgaggcgccgggacagcgcctccggggacgcagccaaggcaaaggccaagtccgcggccgaccccgcggcggccgcgtccccgcctcgcgcgtccccgggccggacaaaagccatggctgcttgttatccggtcaatggaacgggttatgtacgtcatgttgataatccaaatggagacggaagacgtgtgaaatgtattacattacgttaaagaacgggatgccaaggtaagtggaggtatacttcgaatttttctagaaggtaaagcctagtttgctgacattgaacccaaatttgatagactgctgtttttctggtctgaccatcgcaaccctcatgaagtacaaccagcatatgctacaaagtacgcaataactgtttggtatttgatgcagatgagagagcacgagctaaagtaaaatatctaacaggtgaaaaaggtgtgaggattgaactcaataaaccttcagattcagtcagtaaagacgtcttatagagcctttgatccagcaataccccacttcacctacaataattgttgacgctatttgttaatttgtgaatacgaataaatgggataaagaaaaatagacaaccagttcgcattttagtaaggaaacaaacaactttgtgtgttgcatcaaacagaagattctgactgctgtgactttgtaccgcatgatcaacttagaatctgtgattgcttacaggaagaagataagctactaatagaaaatgtttttacctctggatatgaaataagtgccctgtgtagaatttttttcattcttatattttgccagatctgttacgtagctgagttaatttcatctctacttttttaatatatgtcaagtttgaattggaataatttttctatgattaggtacaatttatcaaaactgaattgagaaaaaattacagtatttctcaaaataacgtcaatctatttttgtaaacctcttcatactattaaattttgccctaaaagacctcttaataatgattgttgccagtgactgattaattttattttacttaaaataagaaaaggagcactttaattacaactgaaaaatcagattgttttgcagtccttcctatcttacactaatttgaactcttaaagattgctgcttttttttgatattgtcaataatgaaacccaattgtaaaacagtcaccatttactaccagtaacttttagttaatgtcttacaaggaaaaagacacaataagaagagtttaattttttttttttttttgagcctgggcgacagagtgagactccgtctcaaaaaaaaaaaaaaaaagaaatgtttcattttggtttttcaccaaccttcctttgataggacaaagcagatactaagagggggaggaaaggctgttctgtgtctgaacccagttgggctagtccccaagaggagctgagagccatgtactctaatgcctcccttttcttcccccagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctgggtaagaatgcctttttttttttttcatagtcaaagttagctatggagtttctgtagtattcactactccagacctttttcaagttgaattttttttctttttccctatgtctgttcttacgtattttttttaaacttttatttcagtagtgtttggggaacaagtagtgtttggttgcatggaaaagttcttcagtggtgatttctgagattttggtgcacccatcacccaagggtagtcttttttatccatcaagtctgtacccaatgtgtagtctttgtttttttctttttttttttttttgagactgagtctcattctatcacccaggctggagtggagtggtatgatcttgactcactgcaacatctgcctcccgggttcaagtgattctcctgcctcagcctcctgagtcgctgggattactgagattgtgccactgcactccagcctgggcgacagagtgagactccgtctc

SEQ ID NO: 173 - protein, 306 aa, Homo sapiens
MAVAVDQQIQTPSVQDLQIVKLEEDSHWEQEISLQGNYPGPETSCQSFWHFRYQEASRPREALLQLQKLCCQWLRPEKCTKEQILELLVLEQFPTVLLQEIQIWVRQQHPESGEEAVALVEDLQKEPGRQRLEPRARPSGRTPPAQLRSPWPMTAAGPASRARASETGSTASCAGRWRTCCAAAAAPSAARSASARTGRSTSSCARAARAPSATEGALTRTPAPRRPLQRRRPGTGPWRPGRQRGAGTAPPGTQPRQRPSPRPTPRRPRPRLARPRAGQKPWLLVIRSMERVMYVMLIIQMETEDV

SEQ ID NO: 174 - DNA, 791 bp, Homo sapiens
ttttttggattctgccagctttatttttcagttgaaaactcaaaggaaaaagttacattcccaaaagaaagtaaaacacttccaatgatgtagcctggaggcctgagttcacaggtgcccctaccaaaacagaggccctccccagggtcccctaaagcattcagtcccagtgtgtctaccccaaagagagaagctgcctacctgggcttctgattaagaggcttggggccatcacttcccttcaaggaaactcctgcctgaaaagacccctggatcaggcagggaaagccagtaccaagcagctgaggacctggcttcgtgtcccccaccacgcagtcagcgttctgaagcagtggcttcccaaatggctgttgaataagtgaataaatctcttgggcatgaacaggggccaggtggagttttctctgcagagctggtacttgctggccgcactgtctcctggtttgcagtggaagtgtggaggaagggggagaattactcagaccagtgggagagtttcatgtcccccggaagtattttgagcccagtggcaatgagccctgcttccgtgcgtttgcagcacgtgcggttctgagtttcccggcattccatgctggttattctgtcccagccatgaatcttgtcattgtcagggagctggaattgcagtagaaggtgaaggagtttgaagtctggcagcctagtgctggcatagacaaaatctcaaacacactgtggaggaggggccaggggtacgaatccacgggcacacaggtggatgtaggcggccg

SEQ ID NO: 175 - protein, 30 aa, Homo sapiens [sequence omitted]

SEQ ID NO: 176 - DNA, 1264 bp, Homo sapiens
tatatatcgtgatatagaaccctatatcttatctcagttcttttatgttatctccaaatgaattactaagacaaagggataataaatgggaagtgtacaacccggaggacttcagaccagaaaatcaaagagagatgatgggaaagggtggagtaatgctgagttttgaagaatgggcacatttagacagaccaaagactgagcatcatatcattgctgccgttccatgaactgagagcaaactgttagatcatgacctgctacagaatcactaggcatcaggaagaagagtaggtatatggtctgtattagagtatagcaatggattattcttccagctgccaagaagtcaagaaggaaagcctgtatttgactttatcatttctattgaatgtctgagtgatacatagagtagtaattttagacatttaagtaactaaagatttatatagctttagtatgtaagctgttatatttaaaaatgcttgaaaaaataagagttgttctccagaaattattcattttcctatgattagcacagctgagaccttacaggtgcactgctattgagtattctcccaaccttttaaattttataggtctaattgttggtaaggtattgtggaaggagttctaagacttgctcctgctttaattgacgttgcaataataatcataataaaattgttggtcaaagagtagcacaggagtggttttggtagtgaagaaaataaaaagaaatctgaaggtagagatgaatggaatcagcaaaagtgaaattggttagattagtaagttgtttttctactgggacactcatggatgatactgacatatactccattctcccttgctaatatctagatttttttagtacctctaatactaagagatttttaatttctttgctatacttctgtccttttcttctctattcatgctcaaaagaaagtaagtgctataactactcttttttgtttgcttaaaaaatgactcatgaacttaaggtacttaagtatggacactcctgacaactaataccatagcggagaactactgagttaaagggtaccagtgcaaatagagggctgaaaacaaggaaggtcagtcagtgaatgggaaagaaatatgacaaagcctaggaaagggagctcctctagcatcaaactgtctgcatgtcgagtctcagaaaaacaaggattcgtcagtcaacccctttctgcatgcacagtggatttagggtaaagtttatgttaccctgtct

SEQ ID NO: 177 - protein, 29 aa, Homo sapiens
MSSLRKTRIRQSTPFCMHSGFRVKFMLPC

SEQ ID NO: 178 - DNA, 1110 bp, Homo sapiens
ggcactggagcgaacactgggcagattccccccgacatcatttagacgtgtgcctttattcagtaccagggtaccagggccggcctgggtgccaggtagggaggcaggagcaagaaagtggaggctcccctggcagaggttccctctggaaggagcatggcttgttgggactggaggccagaggctggggaggcttcctgagggaggtgaggggaaagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctggggggcccctcccctcgacccccagcctgggtagagccaccaggtacgacgaccaggtaccagaaaccaccaggcacacggggcagaaagcagcgtcatg

SEQ ID NO: 179 - protein, 107 aa, Homo sapiens
MLQGPFRIWEGAVWREGGRRRWTWGKFRSEEVQAGTCGRYQPGHWWPPPCPVCFHRPIWLVLAVLECHRLAGASGGPLPSTPSLGRATRYDDQVPETTRHTGQKAAS

SEQ ID NO: 180 - DNA, 1135 bp, Homo sapiens
gggggtttttgctagaaaagcactcctggagcttgccaccagcttggacttctagggactttcctctcagccaggaaggattttgatattcatcagaaatacctccagaagattcaaggagctgtagaggtgaagtaagcctgtgaaggaccagcatgggaatcctatactctgagcccatctgccaagcagcctatcagaatgactttggacaagtgtggcggtgggtgaaagaagacagcagctatgccaacgttcaagatggctttaatggagacacgcccctgatctgtgcttgcaggcgagggcatgtgagaatcgtttccttccttttaagaagaaatgctaatgtcaacctcaaaaaccagaaagagagaacctgcttgcatcatgctgtgaagaaaaaatttaccttcattgattatctactaattatcctcttaatgcctgttctgcttattgggtatttcctcatggtatcaaagacaaagcagaatgaggctcttgtacgaatgctacttgatgctggtgtcgaagttaatgctacagattgttatggctgtaccgcattacattatgcctgtgaaatgaaaaaccagtctcttatccctctgctcttggaagcccgtgcagaccccacaataaagaataagcatggtgagagctcactggatattgcacggagattaaaattttcccagattgaattaatgctaaggaaagcattgtaatccttgtgaccacaccgatggagatacagaaaaagttaacgactggattctatcttcattttagacttttggtctgtgggccatttaacctggatgccaccattttatggggataatgatgcttaccatggttaatgttttggaagagctttttatttatagcattgtttactcagtcaagttcaccatggccgtaatccttctaagggaaacactaaagttgttgtagtctccacttcagtcagaaactgatgtttcagctaggcacagtggtacatgcctgtaatcccagctacttgggaggctgaggtgggaggatcacttgaactcaggagtttgagagcagccagggcaacacagcgagaccctgtcccaaaaaaaaaaaaaaaaaaaaaaaaaaaaaa

SEQ ID NO: 181 - protein, 191 aa, Homo sapiens
MGILYSEPICQAAYQNDFGQVWRWVKEDSSYANVQDGFNGDTPLICACRRGHVRIVSFLLRRNANVNLKNQKERTCLHHAVKKKFTFIDYLLIILLMPVLLIGYFLMVSKTKQNEALVRMLLDAGVEVNATDCYGCTALHYACEMKNQSLIPLLLEARADPTIKNKHGESSLDIARRLKFSQIELMLRKAL

SEQ ID NO: 182 - DNA, 5130 bp, Homo sapiens; identical to SEQ ID NO: 11

SEQ ID NO: 183 - protein, 1709 aa, Homo sapiens; identical to SEQ ID NO: 12

SEQ ID NO: 184 - DNA, 1639 bp, Homo sapiens
agcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgagccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaagaaacaattgggtacccagttaaattttcatttcagataaacaacaaataattttttagtataagtacattattgtttatctgaaagttttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 185 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 186 - DNA, 3400 bp, Homo sapiens
ggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaaaaa

SEQ ID NO: 187 - protein, 970 aa, Homo sapiens
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 188 - DNA, 4192 bp, Homo sapiens
gaattcgggatcagggcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagactccctggcattgatcggcatagatggcagcgctggaggaggacttgtactggggccgctggccccacatcagtgtccgtcatcccggcgtccagcccctggtgtgctgaagctcaggcccttccttgtgccctagtctcctgcactgagcttgtgagctcttctgctcaggcgggtcccctggcattgaccagcatagatggtggccctggaggaggacttgtattggggcactggcccacgtcagtgttcgtcagctggcatcagccctggtgtgtgaagtcaggccttctgttgccta

SEQ ID NO: 189 - protein, 72 aa, Homo sapiens
IRDQGKHCGAVPYARLPCEMIQDQNKALDCSKTQNSSRAEGGRLIWIEGPKYKTDGLRLETRGLRWKAHVPR

SEQ ID NO: 190 - DNA, 1869 bp, Homo sapiens
gtcacccccagcgggcgcgggccggagcacgggcacccagcatgggggtactgctcacacagaggacgctgctcagtctggtccttgcactcctgtttccaagcatggcgagcatggcggctataggcagctgctcgaaagagtaccgcgtgctccttggccagctccagaagcagacagatctcatgcaggacaccagcagactcctggacccctatatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctggagggctgcaggttcctgcatggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtagcctcgagagcaccccttgccggtgaaggatgcggcaggtgctctgtggatgagaggaaccatcgcaggatgacagctcccgggtccccaaacctgttcccctctgctactagccactgagaagtgcactttaagaggtgggagctgggcagacccctctacctcctccaggctgggagacagagtcaggctgttgcgctcccacctcagccccaagttccccaggcccagtggggtggccgggcgggccacgcgggaccgactttccattgattcaggggtctgatgacacaggctgactcatggccgggctgactgcccccctgccttgctccccgaggcctgccggtccttccctctcatgacttgcagggccgttgcccccagacttcctcctttccgtgtttctgaaggggaggtcacagcctgagctggcctcctatgcctcatcatgtcccaaaccagacacctggatgtctgggtgacctcactttaggcagctgtaacagcggcagggtgtcccaggagccctgatccgggggtccagggaatggagctcaggtcccaggccagccccgaagtcgccacgtggcctggggcaggtcactttacctctgtggacctgttttctctttgtgaagctagggagttagaggctgtacaaggcccccactgcctgtcggttgcttggattccctgacgtaaggtggatattaaaaatctgtaaatcaggacaggtggtgcaaatggcgctgggaggtgtacacggaggtctctgtaaaagcagacccacctcccagcgccgggaagcccgtcttgggtcctcgctgctggctgctccccctggtggtggatcctggaattttctcacgcaggagccattgctctcctagagggggtctcagaaactgcgaggccagttccttggagggacatgactaatttatcgatttttatcaatttttatcagttttatatttataagccttatttatgatgtatatttaatgttaatattgtgcaaacttatatttaaaacttgcctggtttctaaaaaaaaaaaaaaaaaa

SEQ ID NO: 191 - protein, 252 aa, Homo sapiens
MGVLLTQRTLLSLVLALLFPSMASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 192 - DNA, 1813 bp, Homo sapiens
caggccttgaggttttggcagctctggaggatgagagagaacatggccaggggcccttgcaacgcgccgagatgggtgtccctgatggtgctcgtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtcgggtggctgatccaactcttccacaaaaaaattgagtctgcgcttcgaaacaagatgaacagccaggtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggttgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccgcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtg

SEQ ID NO: 193 - protein, 487 aa, Homo sapiens
MRENMARGPCNAPRWVSLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 194 - DNA, 647 bp, Homo sapiens
gctcactgagcaccgtcccagcatccggacaccacagcggcccttcgctccacgcagaaaaccacacttctcataccttcactcaacacttccttccccaaagccagaagatgcacaaggaggaacatgaggtggctgtgctgggggcaccccccagcaccatccttccaaggtccaccgtgattaacatccacagcgagacctccgtgcccgaccatgtcgtctggtccctgttcaacaccctcttcttgaactggtgctgtctgggcttcatagcattcgcctactccgtaaagtctagggacaggaagatggttggcgacgtgaccggggcccaggcctatgcctccaccgccaagtgcctgaacatctgggccctgattctgggcatcctcatgaccattggattcatcctgttactggtattcggctctgtaacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 195 - protein, 125 aa, Homo sapiens
MHKEEHEVAVLGAPPSTILPRSTVINIHSETSVPDHVVWSLFNTLFLNWCCLGFIAFAYSVKSRDRKMVGDVTGAQAYASTAKCLNIWALILGILMTIGFILLLVFGSVTVYHIMLQIIQEKRGY

SEQ ID NO: 196 - DNA, 1128 bp, Homo sapiens
atgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcag

SEQ ID NO: 197 - protein, 374 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 198 - DNA, 1046 bp, Homo sapiens
gaagaagaagaccacaaaagacatgactatccaactttttatgacaaactgcaaggaataaaggaagaataagtccatgtactgtaccacagaagttctgtctgcatcttggacctgaacttgatcatcatcagcttgataagagactttttgactctatatccttgcagttaagaagaaagcacttttttgtaatgtttgttttaatggttcaaaaaaaatctttcttataaagagcataggtagaattagtgaactctttggatcctttgtacagataaaggttatagatttcttgtgttgaatattaaaaaagcaaggatgtctaaccattaagattatccaaagtcaggcgtgagccactgtgcctggccccaagttttgcatcttttaatgccctctgaacaaatacatagagaaaactctcagaacaattaaaacctgcagagcaacagtgtcctccatgtcttaggtttcaagtttgcctctaaaattctaatccatatttttctacttctcagataatttatgtgtgtgtactcttcctagacgtacaagagactttttaatgctaaatatttgtcagtgcttaacaaaaactcaatttcacattactcatattgtttttgttttaattgaatgtgaattaaatttttattagttatttgatttggaatgttatgtatgccattaacactattaggggaatctctagcatttctgtatttttaaagaatttgattcttttgtagattctgcctgtgtggtcattttaaaacatgtgtgacatatatcagtaccttcattcttctatattttgtgtctcctccaacctccaactttttttgttttttgaaaaatgtttctctaacacctcaacagtttaaggtaatttagtacacatatatcagtatttttgtgatctgaaaaagcaacccattttctaaattcatatttttcctaaaactttactatgtttttattttaagaggtttcctgttatatacactttttacacatgcaaataaactttataccaagtgagt

SEQ ID NO: 199 - protein, 8 aa, Homo sapiens
MQINFIPS

SEQ ID NO: 200 - DNA, 1915 bp, Homo sapiens
gctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccataaaaaaaaaaaaaaaaaaaaaaaaaaaaaaaaaaaaaaa

SEQ ID NO: 201 - protein, 314 aa, Homo sapiens
MGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 202 - DNA, 1098 bp, Homo sapiens
atgtcagccccactggatgccgccctccacgcccttcaggaggagcaggccagaccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgccaaaaaaaaaaaaaaaaaaaaaaaaaaaaaaaaaaaaaaaa

SEQ ID NO: 203 - DNA, 4076 bp, Homo sapiens
aaaaataacagccgtatgcctctgctaagtactaactacctcatcaccttttgtgcagacaggcaggttacatttggtttaaggaattaggaatatgttctttccagcaccttagtaacccacgcgattgtgattcttttctcttcttgactgtgataggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaattaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattaaaaaaaaaaaaaaaaaaaaaaaaaaaaaa

SEQ ID NO: 204 - protein, 378 aa, Homo sapiens
MRMLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 205 - DNA, 345 bp, Homo sapiens
ttttttttcattaaaaaatagtgctctttattataaattactgaaatgtttcttttctgaatataaatataaatatgtgcaaagtttgacttggattgggattttgttgagttcttcaagcatctcctaatagcctcaagggcctgagtaggggggaggagagaggactggaggtggaatctttataaaagacagagtgattgaggcagattgtaaacattattaaaaaacaagaaacaaacaaaaaaatagagaaaaaaaccaccccaacacacaactgccctgtccagcccaatacctgacacagaatactttgtgtttgtttagttgcccccccccacataa

SEQ ID NO: 206 - DNA, 4465 bp, Homo sapiens
caattgtcatacgacttgcagtgagcgtcaggagcacgtccaggaactcctcagcagcgcctccttcagctccacagccagacgccctcagacagcaaagcctacccccgcgccgcgccctgcccgccgctcggatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtcttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactatcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactattta

SEQ ID NO: 207 - protein, 604 aa, Homo sapiens
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 208 - DNA, 1639 bp, Homo sapiens; identical to SEQ ID NO: 184

SEQ ID NO: 209 - protein, 99 aa, Homo sapiens; identical to SEQ ID NO: 185

SEQ ID NO: 210 - DNA, 3579 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtgaggagcataagaagaagaacccagatgcttcagtcaagttctcagagtttttaaagaagtgctcagagacatggaagaccatttttgctaaagagaaaggaaaatttgaagatatggcaaaggcggacaaggcccattatgaaagagaaatgaaaacctatatccctcctaaaggggagaaaaaaaagaagttcaaggatcccaatgcacccaagaggcctcctttggcctttttcctgttctgctctgagtatcgcccaaaaatcaaaggagaacatcctggcctgtccattgatgatgttgtgaagaaactggcagggatgtggaataacaccgctgcagctgacaagcagttttatgaaaagaaggctgcaaagctgaaggaaaaatacaaaaaggatattgctgcatatcgagctaaaggaaagcctaattcagcaaaaaagagagttgtcaaggctgaaaaaagcaagaaaaagaaggaagaggaagaagatgaagaggatgaacaagaggaggaaaatgaagaagatgatgataaataagttgcttctagtgcagtttttttcttgtctataaagcatttaagctgcctgtacacaactcactccttttaaagaaaaaaacttcaacgtaagactgtgtaagatttgtttttaaaccgtacactgtgtttttttgtatagttaaccactaccgaatgtgtcttcagatagccctgtcctggtggtatttagccactaacctttgcctggtacagtatgggggttgtaaattggcatggaaatttaaagcaggttcttgttagtgcacagcacaaattagttgtataggaggatggtagttttttcaccttcagttgtctctgatgtagcttatacaaaacatttgttgttctgttaactgaatgccactctgtaattgcaaaaaaaaaaaacagttgcagctgttttgttgacattctgaatgcttctaagtaaatacaatttttaaaaaaccgtatgagggaactgtgtagacaaggtaccaggtcagtcttcttccatgttctattagctccacaaagccaatctcaatccctcaaaacaatcttgtcatacttgaaaatatgacactctagtcaaagccttggtaaaataatcagtgtttccaatctgtcctgttacaaaagaaacagattattattgaacttatgcaaataaccattgtcataagaatgtttatgaatagtttccaaattatggcaaattcatgtagagagagaaaagtaactgttttggttttgctcacaaaagtctactttacctaagggctgtcagatataagtaacttaaaagaaagagaagttttcttgacttttgaaaacaaaatatgaaaagaatcggcaatgtttcaaacaaaaagtcataaaagtcactttattcctccatcaaaaaaaaaaaaaaaaaaaaaa

SEQ ID NO: 211 - protein, 879 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 212 - DNA, 1434 bp, Homo sapiens
ggggaagtcgaggcgggagtgactctgcttccgtttctggttttgctctagtgtttgggtttcttcgcggctgctcaagatgaaccgactcttcgggaaagcgaaacccaaggctccgccgcccagcctgactggctgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggaaaaaaaaaaaaatcaaaaaaaaaaaaaaaaaaaaaaaaaaa

SEQ ID NO: 213 - protein, 219 aa, Homo sapiens
MNRLFGKAKPKAPPPSLTGCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 214 - DNA, 316 bp, Homo sapiens
cctcttctcttctcgcttgggaacgccggtctcacctcggcttgcaatggaccccaactgctcctgcgccgctggaggctcctacgcctgcgccggctcctgcaagtgcaaaaagtgcaaatgcacctcctgcaagaagagctgctgctcctgttgccccctgggctgtgccaagtgtgcccagggctgcatccgcaaaggggcttcggaaaagtgcagctgctgtgcctgatgtcgggactgccctgctctcggatgaaaacagaatgacacgtaaagtccgggatttttttttctacaactccgactcatttgc

SEQ ID NO: 215 - protein, 61 aa, Homo sapiens
MDPNCSCAAGGSYACAGSCKCKKCKCTSCKKSCCSCCPLGCAKCAQGCIRKGASEKCSCCA

SEQ ID NO: 216 - DNA, 353 bp, Homo sapiens
gaatataaagtgcactaatgaaagtgtaatgcgcttggaatcatcccatagaagcgcatacgcctgttgcgttcagcgggtccatgtgcttccacaaaacccggtccctggtgccataaaggttgtgggaccactgtttagccaggatgcatagcatgggtttatgaattccctatctttgcagcacatcctttatttctggcttgcatgggacttgaaagcctaaaacaactaaatgctaagaaaaattatttttaaaattatgacaaaaatattttctatttcagatgtatagatctgcaatccagaaactatgaatttttttcagttgagtagtctgtttgccaaaaaat

SEQ ID NO: 217 - protein, 50 aa, Homo sapiens
NIKCTNESVMRLESSHRSAYACCVQRVHVLPQNPVPGAIKVVGPLFSQDA

SEQ ID NO: 218 - DNA, 2815 bp, Homo sapiens
gaattcggcacgagctcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagatcgagagacagaagattctgaaagggttcaatgaaatgagagtcatcttggacaatgaggagcagagagagctgcaaaagctggaggaaggtgaggtgaatgtgctggacaacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaaagtcataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctctaaaaaaaaaa

SEQ ID NO: 219 - protein, 442 aa, Homo sapiens
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKEDQEAEKLEDDIRQERTAWKIERQKILKGFNEMRVILDNEEQRELQKLEEGEVNVLDNLAAATDQLVQQRQDASTLISDLQRRLTGSSVEMLQDVIDVMKRSESWTLKKPKSVSKKLKSVFRVPDLSGMLQVLKELTDVQYYWVDVMLNPGSATSNVAISVDQRQVKTVRTCTFKNSNPCDFSAFGVFGCQYFSSGKYYWEVDVSGKIAWILGVHSKISSLNKRKSSGFAFDPSVNYSKVYSRYRPQYGYWVIGLQNTCEYNAFEDSSSSDPKVLTLFMAVLPVVLGFS

SEQ ID NO: 220 - DNA, 2796 bp, Homo sapiens
  Unsure 127,139,200,202-203,208-209,211,213,216-286,793-833: Unknown base
aaggcagagatttgaacagagggttgggttatctggctccaaaacccctgtccttttcttgctatttctctacctggagtttgccaactgagcaagcccactctggtggaaccagccactgcaaatnctttgtgtcttnccagagaataccaacatttcagttttgagtgagggaacgttggctctgactgcctttgcgngnnggagnngncnacnnnnnnnnnnnnnnnnnnnnnnnnnnnnnnnnnnnnnnnnnnnnnnnnnnnnnnnnnnnnnnnnnnnnnnnctaagaaactgcatgttaagattccacctactgaatcatgagcggaggaagtcgtgggacactggctggtggagaagccatctagcatattattcaagatgacaccagctccaagtctggaatgagtctgtgggaaaccaaggtacttcttggacattcacctataactcacgtgtttcgtggactggtcacagtggttcggataaattgaacagaactttatgaacacctcccagcaccaggtgttgttatagaaactaagaacagagcaatgagaaggacccaactcctgctctcaaatggatgcagtggaaaataagcagactttgaaccattggttagtcagaagagacttgggagactgaaaacttgtttcaacttgggccagaacaaaaaattaggaagcaacacttgctgccaacatgatttacaagtgccagcaccttcacctctgttacttccttctcactacacactgaaagcagttgctcttgttttacatggacnnnnnnnnnnnnnnnnnnnnnnnnnnnnnnnnnnnnnnnnnagtggaattgagattgaatcagttccaactgacttgcaatcttgtgcttttcagacgatcccactaattgtccatatctgttccaaagccaaatcaagaggaacaagagcaaaatctgtcctctcatattattcatggtcctgcgtggatcataaatggcatgctgactgtctgatggagacttacttttcccttccccctggacacctgccatggcaatgacagaggctgtattttactgaagtggagggaagaggtgaatgcaaatgcctagggcctaagtatacaggaaggtgtagggagaggtaagcagtgtgtatgtggaggagatagcagacgtaagcagagagaaatcagagagcttagttcttcctctggggcgcactttgtggttaattaggacatgcaaatgagctagaagctcatttaatatcctccctgacatgtagccccaccccaccctgccccacttccctggcaggtacaagggccacctgattggcccaggtatctgtggaaggttccacctgcttctttgtggcccagggaacagaaaagagtccctgctgggcatggctagtggggccggcctggtctccctcctccctttctcttcccaacctttcagacttgggacctctcttttccctctccctcagacacttcccttgtgccccgcccctcagggtgatctctgaacccaaacttgccccaaagaaggttgctctgtcctctccacatccccatctcctccctagggccttgttggggagaggctcctccatctttcccaagtcacaccatcgtttcctacgtggtctggacaagagcaagagcacaccttgtccccaccttctccagagcagccagaacccacctcaggtgccttccccatccggtgcagttaaggcacttctgccagcaccatggtatgagcactagacttggagttaagatttgagagccccctctgtcactgtggaagcttgagcatgttgcttgatctctctgaaccttgtgtttctcatctgtgaaaggtgataatgtggggctgctgtgagatttaaaggacataatgcacctacggtccaagcactgcctggaatacagcagaagctcagcagatactggacaacccatccccttagtagaggcactaaccatgtgacccaaggcaaaagtgcttaagaaaaagtgctttctctgagcgttggtctcttcttctgtcgaaacatttatattgatttaatatctcacaggattgtagcaagggtcagagaagacaataggtgacatgtttttgtacactgtatactagccacccagatgggctgttatttgctaaatggcaaatttacactgttccccaaaggatgacatgcactggggaggcggggggtgtggaggtggagaaaggctgagcttggagaaaaggtgcttgaggaccccactgcctaaggacctgctctaggaaacattcccactccctacaccctagctgcccctcacagtcaacccttaaggacctcaaattcttggcaaggggtaaagagttgaaagtgccaagtcctagtggttttgagaagcctctggtctgctctttctgctctgtaaagtcttagttgccagagtcccctatagcccccacatcgctcccttcctcctgccctccggccaccctggaaactaatggcctaaaggtgctgtggctgtcctcctaaaatccattccctcctgatggggtggaggaatctgtgaagcccaccttcaggagaggtctcggggctcgggctggtgctgccagagaaagggtgactgaaccagaaaggcctaggggaaagcagctcaaactgcagccatccccttagtacgattactaggatgtcccttgccttccttttgcctcctccacccaacccctaaaataaacagtatgatgaaacctctcttccagattccctct

SEQ ID NO: 221 - DNA, 3934 bp, Homo sapiens
cctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaacta

SEQ ID NO: 222 - protein, 799 aa, Homo sapiens
MELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 223 - DNA, 1761 bp, Homo sapiens
atggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgcctcgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacggaaaaaaagaagaaagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagaggactgttaataacgatgatccatgtgttttactctaa

SEQ ID NO: 224 - protein, 586 aa, Homo sapiens
MALEIHMSDPMCLIENFNEQLKVNQEALEILSAITQPVVVVAIVGLYRTGKSYLMNKLAGKNKGFSVASTVQSHTKGIWIWCVPHPNWPNHTLVLLDTEGLGDVEKADNKNDIQIFALALLLSSTFVYNTVNKIDQGAIDLLHNVTELTDLLKARNSPDLDRVEDPADSASFFPDLVWTLRDFCLGLEIDGQLVTPDEYLENSLRPKQGSDQRVQNFNLPRLCIQKFFPKKKCFIFDLPAHQKKLAQLETLPDDELEPEFVQQVTEFCSYIFSHSMTKTLPGGIMVNGSRLKNLVLTYVNAISSGDLPCIENAVLALAQRENSAAVQKAIAHYDQQMGQKVQLPMETLQELLDLHRTSEREAIEVFMKNSFKDVDQSFQKELETLLDAKQNDICKRNLEASSDYCSALLKDIFGPLEEAVKQGIYSKPGGHNLFIQKTEELKAKYYREPRKGIQAEEVLQKYLKSKESVSHAILQTDQALTETEKKKKEAQVKAEAEKAEAQRLAAIQRQNEQMMQERERLHQEQVRQMEIAKQNWLAEQQKMQEQQMQEQAAQLSTTFQAQNRSLLSELQHAQRTVNNDDPCVLL

SEQ ID NO: 225 - DNA, 3204 bp, Homo sapiens
ggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgagctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgcgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttatttttaaaaaaaaaaaaaaaaaaaaaa

SEQ ID NO: 226 - protein, 589 aa, Homo sapiens
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGILDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 227 - DNA, 2881 bp, Homo sapiens; identical to SEQ ID NO: 148

SEQ ID NO: 228 - protein, 592 aa, Homo sapiens; identical to SEQ ID NO: 149

SEQ ID NO: 229 - DNA, 808 bp, Homo sapiens
tgctcccttgggctctagagaggaggcccctcttagccctcagcccctccttcctctctatcttaaagtaatttgatcctcaggaatttgttccgccctcatctggcccggccaaatcccgatttgacaaatgccaggaaaaggaaactgttgagaaaccgaaactactggggaaagggagggctcactgagtaaccatcccagtaacccgaccgccgctggtcttcgctggacaccatgagtcacactgtccaaaccttcttctctcctgtcaacagtggccagccccccaactatgagatgctcaaggaggagcacgaggtggctgtgctgggggggccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtgctgctg

SEQ ID NO: 230 - protein, 133 aa, Homo sapiens
MSHTVQTFFSPVNSGQPPNYEMLKEEHEVAVLGGPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAYG

SEQ ID NO: 231 - DNA, 1535 bp, Homo sapiens
gcgcgttcgggagcttcggccctgcgtaggaggcgggtgcaggtgtgggtgctgagccgcccgccgcctggagggggagacagcttcaggacacgcaggccgcagcgagggcccgggcccgggggatcccaggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgaaatgtgcctcaagtcccagctggtggaccttgtagccgagggctactgggaggagctactagacacattccggccggacatcgtggttaaggactggtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggcactgtggctcacgcctgtaatcccagcactttgggagaccgaggcaggtggatcacgaggtcaggagacagagaccatcctggccaacacggtgaaaccctgtctctactaaaaatacaaaaaattagccgggcgtggtggcgggcgcctgtagtcccagctactcgggaggctgatgcagaagaatggcgtgaacccggaaggcagagcttgcagtgagccgagatcacgccactgcactccagcctgggtgacagagcgagactctggctcataaaataataataataataaataaataaaaaataaatggttttcagtaaaaaaaaaaaaaaaaaa

SEQ ID NO: 232 - protein, 293 aa, Homo sapiens
MDAPHSKAALDSINELPENILLELFTHVPARQLLLNCRLVCSLWRDLIDLMTLWKRKCLREGFITKDWDQPVADWKIFYFLRSLHRNLLRNPCAEEDMFAWQIDFNGGDRWKVESLPGAHGTDFPDPKVKKYFVTSYEMCLKSQLVDLVAEGYWEELLDTFRPDIVVKDWFAARADCGCTYQLKVQLASADYFVLASFEPPPVTIQQWNNATWTEVSYTFSDYPRGVRYILFQHGGRDTQYWAGWYGPRVTNSSIVVSPKMTRNQASSEAQPGQKHGQEEAAQSPYRAVVQIF

SEQ ID NO: 233 - DNA, 3380 bp, Homo sapiens
gcgcgccggcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaaaaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaatcaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcaataaaatgattgttttactctgaaaaaaaaaaaaaaa

SEQ ID NO: 234 - protein, 1025 aa, Homo sapiens [sequence omitted]

SEQ ID NO: 235 - DNA, 3401 bp, Homo sapiens
aaaatttgaagacaagatgggcacctactctacaattctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaaacaattgtttatatatagaatatggaatcaatgaaaaaatcacaatacccatcactcccgcttttttaggtcaacttagaagtggcagaagcatagagaaggtgtctttttacctgggatttcccattggaggcccacttgcttatgacattgaaattgtttaagagcctgatattcttcctccaagaatttgatctcagtacccatttaatttttttggactcaagatctatgctttaaaccggcaaggttatagatacagcctctagctcttcagatctgtacatgcagtatttaatttcctcttaaacatgttatgagttctacaaggacaatagtgaaaaaggaaggagtgagatatatgaaaagtagcaaatatgttccttggtttggttaacatcattgatgacaaaataataaggagctatgactggagtcaggagaagttagtgtaataagctggctacacagaaccccactacttaccaggcatggattgaagaagattgtctactcaaatggcatttagacattagaatgtctgggaaaatatttctcaaagacagcaaaaacctctcaaactgaggagcaacatttattcttactaagcagatcatcaatgtatcatgtgcttggcactcaaggatcttccaaaacagaggaccaaccagtcttctgaaggtcatgcccacagaagtcatcggaccttaccaaagtaggttggagaattagattgccttttcatgcagtgagattcagttaagcaaaaatgaaatttgtctctatagctaattagcttatcaactcccctccaaacaaacaattaaaaaaaaaacatacagacactcaaattccacaagctaatgaacaaaagggactcttgtgagaagactaatgagtccctcatccagaagatgccaatgtactggcagattaacatacaacctatgttttgaacaaaaacaaccagcgatacgtaatcaaaatgtaattttcccctaataaaattatggatatgggcagtcatcaatggctgccaaaaccattaagtggaaagctgattaaaaaacaaaaatttctaatggatttatcaaactgtcccaaatcctgataaatattaacatcacagaggaagaccagacattatgggcctggaagtactataggagtgcacacatcacccgtgacatggtcttgccaaataattaaacctgaatttgatcaggtctctggatcttatttgcaattcaaaagaaattttaaaaaaatcctactaacaccaccacaaatatgcaatcagcaatatccagaaaggggaaattcacaggacaaaaacctggttttcttttttggtttcttcaaccaaaaaagaaagaaattgcaaaggaccaaaaaaatgttggggaatctatacattataagggacttaacaactaaagggcaacatatagactttagatcctaatttgagcaaaatctaaaatcaattattaggcaatcagaaaaatttgaacacagactagatatttgaggatattaaggtactatattattgaagattccatggttatgttttttaaagagttcatgccttttagagatacatactaaagtatttgtaaataaatgacatgatctagaaaaaaaaaaaaaaaa

SEQ ID NO: 236 - protein, 630 aa, Homo sapiens
MGTYSTILIKTEVIECGNYCGVRIIHSLIAEFSLEELKKSYHLNKSQIMLDMLTENLFFDTGMGKSKFLQDMHTLLLTRHRDEHEGETGNWFSPFIEALHKDEGNEAVEAVLLESIHRFNPNAFICQALARHFYIKKKDFGNALNWAKQAKIIEPDNSYISDTLGQVYKSKIRWWIEENGGNGNISVDDLIALLDLAEHASSAFKESQQQSEDREYEVKERLYPKSKRRYDTYNIAGYQGEIEVGLYTIQILQLIPFFDNKNELSKRYMVNFVSGSSDIPGDPNNEYKLALKNYIPYLTKLKFSLKKSFDFFDEYFVLLKPRNNIKQNEEAKTRRKVAGYFKKYVDIFCLLEESQNNTGLGSKFSEPLQVERCRRNLVALKADKFSGLLEYLIKSQEDAISTMKCIVNEYTFLLEQCTVKIQSKEKLNFILANIILSCIQPTSRLVKPVEKLKDQLREVLQPIGLTYQFSEPYFLASLLFWPENQQLDQHSEQMKEYAQALKNSFKGQYKHMHRTKQPIAYFFLGKGKRLERLVHKGKIDQCFKKTPDINSLWQSGDVWKEEKVQELLLRLQGRAENNCLYIEYGINEKITIPITPAFLGQLRSGRSIEKVSFYLGFPIGGPLAYDIEIV

SEQ ID NO: 237 - DNA, 6273 bp, Homo sapiens
ggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaaaaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaccagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacatgcaaaatcctttctttcttatctctttagctctggactgtgattggcaaggtccttcttccagcattcagcccagctaagcccccaggtgccccatcccaaccctgttcctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcaggaaggccaaggagaaaggccttatagagacgttgatatgttggatgtgcctaggctttcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgttgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatcctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccggcttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatccttatttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttgggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatggtattattgtgcaactggtatcatcatccaaagaaaaaaacagacaccaagtattcaaactcttgcaaacgtcaacccttcggtcatgcaatgttctctttttaatgtcccaggagaacacagtgtcagaatatttgtctgtcctacagtgctgagatatatgttggaca

SEQ ID NO: 238 - protein, 973 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQKKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRPEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 239 - DNA, 1761 bp, Homo sapiens
ttgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaacctggaccaagctaccaggctagcacaccatgccgcctcagccaggatgccagcagcaacctacccaatgcagtacccaccaccttaaccagcccagcccatgggcccaccggcttacaacgagaccctggcttgaggagcagccgcgccctaccccgccagccagcctccttacaacccggcctacatggatgccccgaagcggccctctgagcattccctggcctctctggctgccacttggttatgttgtgtgtgtgcgtgagtggtgtgcaggcgcggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggccctgagaaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggaaaaaaaaaaaaaaaaaaaaaaaaaaaaaa

SEQ ID NO: 240 - protein, 170 aa, Homo sapiens
MPPQPGCQQQPTQCSTHHLNQPSPWAHRLTTRPWLEEQPRPTPPASLLTTRPTWMPRSGPLSIPWPLWLPLGYVVCVREWCAGAVPYAPCVLCVSCLYMWLPLMLTRWGTILARVGWDQTLFSSSPEIMLPKISSQTQRMGWWGAPCEVALRRWGPLQGTSGVLLQLTLG

SEQ ID NO: 241 - DNA, 415 bp, Homo sapiens
ccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgcmaagtgtgcccagggctgcatctgcaaagggacgtcagacaagtgcagctgctgtgcctgatgccaggacagctgtgctctcagatgtaaatagagcaacctatataaacctggatttttttttttttttttttgtacaaccctgacccgtttgctacatctttttttctatgaaatatgtgaatggcaataaattcatctagactaaaaaaaaaaaaaaaaaaaaaaaaaaaaaaaa

SEQ ID NO: 242 - protein, 61 aa, Homo sapiens
MDPNCSCSPVGSCACAGSCKCKECKCTSCKKSCCSCCPVGCAKCAQGCICKGTSDKCSCCA

SEQ ID NO: 243 - DNA, 1671 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 244 - protein, 287 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 245 - DNA, 1348 bp, Homo sapiens
  Unsure 1104: Unknown base
ggatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggctgcacgcctgtaatcccagcactttggaggccaaggcgggtggatcacgaggtcaggagatcgagaccatcctggctaacacggtgaaaccctgtctctactaaaaatacaaaaaattagccaggggtggtgcgggcgcctgtagtcccagctactctggaggctgaggcaggagagtacgtgaacccgggaggcagagcttgcggtgagccgagattgcgctactgcactccagcctgggcgacagnaccagactccatctcaaaaaaaaaaaaaaccagactgaattaattttaactgaaaatttctcttatgttccaaggtacacaataggtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 246 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 247 - DNA, 1406 bp, Homo sapiens
gagggcgccatgaggagcctgtgctgcgccccactcctgctcctcttgctgctgccgccgctgctgctcacgccccgcgctggggacgccgccgtgatcaccggggcttgtgacaaggactcccaatgtggtggaggcatgtgctgtgctgtcagtatctgggtcaagagcataaggatttgcacacctatgggcaaactgggagacagctgccatccactgactcgtaaagttccattttttgggcggaggatgcatcacacttgcccatgtctgccaggcttggcctgtttacggacttcatttaaccgatttatttgtttagcccaaaagtaatcgctctggagtagaaaccaaatgtgaatagccacatcttacctgtaaagtcttacttgtgattgtgccaaacaaaaaatgtgccagaaagaaatgctcttgcttcctcaactttccaagtaacatttttatctttgatttgtaaatgatttttttttttttttttatcgaaagagaattttacttttggatagaaatatgaagtgtaaggcattatggaactggttcttatttccctgtttgtgttttggtttgatttggcttttttcttaaatgtcaaaaacgtacccattttcacaaaaatgaggaaaataagaatttgatattttgttagaaaaacttttttttttttttctcaccaccccaagccccatttgtgccctgccgcacaaatacacctacagcttttggtcccttgcctcttccacctcaaagaatttcaaggctcttaccttactttatttttgtccatttctcttccctcctcttgcattttaaagtggagggtttgtctctttgagtttgatggcagaatcactgatgggaatccagctttttgctggcatttaaatagtgaaaagagtgtatatgtgaacttgacactccaaactcctgtcatggcacggaagctaggagtgctgctggacccttcctaaacctgtcactcaagaggacttcagctctgctgttgggctggtgtgtggacagaaggaatggaaagccaaattaatttagtccagatttctaggtttgggtttttctaaaaataaaagattacatttacttcttttactttttataaagttttttttccttagtctcctacttagagatattctagaaaatgtcacttgaagaggaagtatttattttaatctggcacaacactaattaccatttttaaagcggtattaagttgtaatttaaaccttgtttgtaactgaaaggtcgattgtaatggattgccgtttgtacctgtatcagtattgctgtgtaaaaattctgtatcagaataataacagtactgtatatcatttgatttattttaatattatatccttatttttgtc

SEQ ID NO: 248 - protein, 108 aa, Homo sapiens
MRSLCCAPLLLLLLLPPLLLTPRAGDAAVITGACDKDSQCGGGMCCAVSIWVKSIRICTPMGKLGDSCHPLTRKVPFFGRRMHHTCPCLPGLACLRTSFNRFICLAQK

SEQ ID NO: 249 - DNA, 1276 bp, Homo sapiens
tcgacccacgcgtccgcccacgcgtccgcttaatatctgtattcccagttgcctacgggataaaagcccaaactccttagcagagaatataaggccctagctcccacattatttcagcagtcatcacccactatgttcctcaagactgcagccattaactttttagagttccctaaacatgctgtttactttcatgcctctatcccgttgtctgtggaatgacttccctccttgcccttttcagtgctacaaacccctattctttaagacatagtacaaatggcatctcctggttggcatctttcctgcaggcctacaggcctagtaagtatcttcctcctctgtgctcctgcatacctccattcctttgttatgacatctataactttaataagtactaaaatctgtagtcctacaaaactcaggcatagaactcatttcctttatggytctataatggaactttacccaactctcacgttccccatgaccacagatgtggaaaatttgaatcttgacagttcaaggtgaactcagtcattttcagagttttcatagtcccttcaagattgaaactcagttcctgcaatgtttgccccttttctcctcttttgtctatgctgggagaggcattgtggggagggttgtctggcttatggctcccattgtcctctgcttgataaaccacctgagctttggtcattagcagtctcctgtgcctttcacactcaggtagtgtctgcacaggccactctatgtcttttccatgctgaagaaattcctttccaggccatgtctgtgttcctcctgccacacaggaaatttttgagcatgttcatcctccaagctgaatgcagggtcttgggtagtggtcctcacctgctccagagacttctccagccattgccactctccactcaggtgatgaagctggatgagggactgcacccaccagagtcaggccagggtcctgtctgctctgtgagtccctccaattgttcttattccgagatttccattgttctgccccctcttgactcccagggctctcaagggagtgggggtagtgaagggagccctttcccaagctcccccaagagctctagtcacatcacttctgatacttcttttcccaccagctggaagaaagaactttcatttgtcttgaaatgagaaaaatgttcttagaatattttgtattactctctgctctgtcatttatggtaaacaaaataaaataataaaaaaaaaaaaaaaaaaaaaaaaaagggcggcc

SEQ ID NO: 250 - protein, 83 aa, Homo sapiens
MASPGWHLSCRPTGLVSIFLLCAPAYLHSFVMTSITLISTKICSPTKLRHRTHFLYGSIMELYPTLTFPMTTDVENLNLDSSR

SEQ ID NO: 251 - DNA, 1680 bp, Homo sapiens
agagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcggtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatagtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgccgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggttgcgcacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgt

SEQ ID NO: 252 - protein, 185 aa, Homo sapiens
MAGPRPRWRDQLLFMSIIVLVIVVICLMLYALLWEAGNLTDLPNLRIGFYNFCLWNEDTSTLQCHQFPELEALGVPRVGLGLARLGVYGSLVLTLFAPQPLLLAQCNSDERAWRLAVGFLAVSSVLLAGGLGLFLSYVWKWVRLSLPGPGFLALGSAQALLILLLIAMAVFPLRAERAESKLESC

SEQ ID NO: 253 - DNA, 1692 bp, Homo sapiens
ctggggtttgggggaccgagccgctccgggttcgggatgctgaggagaccgcgggcccgcgccagcctcccacacacacacactctcccggcgcctcggccggccgggcgcggtgtgcaggggtgaggcggtgtctccaggctgaggagggacgcggaggagggtccggcgcggccccgggactggagggtgagtccctcacaaagggcggagcggggctgtcacctggagatcacggagggaagttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctcttggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaa

SEQ ID NO: 254 - protein, 148 aa, Homo sapiens
MSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 255 - DNA, 2709 bp, Homo sapiens
gggaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtgcatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccagcttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaacacaatcaactgtgaggaaggagataaactgaaactcaccagctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtccctaaaaaaatgtacatatacctggttgaaatacaacactatacatacacaccaccatatatactagctgttaatcctatggaatgggggtattgggagtgcttttttaatttttcatagtttttttttaataaaatggcatattttgcatctacaacttctataataagaaaaaataaataaacattatcttttttgtgaaaaaaa

SEQ ID NO: 256 - protein, 729 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVHATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLNTINCEEGDKLKLTSFELAPKSGNTGELRSVIHSHIKVIKTRKNKKDILNPDSSMETSPDFFF

SEQ ID NO: 257 - DNA, 1447 bp, Homo sapiens
tgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaag

SEQ ID NO: 258 - protein, 322 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 259 - DNA, 10442 bp, Homo sapiens
  Unsure 9881,9884,9999,10046: Unknown base
ggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacgggcgtccctgctgtgagctctggccgctgccttccagggctcccgagccacacgctgggcgtgctggctgagggaacatggcttgttggcctcagctgaggttgctgctgtggaagaacctcactttcagaagaagacaaacatgtcagctgttactggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctatatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaaaggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatactctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcgatctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatgtcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatattgggcagccttttttttttttttttaattgcaacaatgcaaaagccaagaaagtataagggtcacaagtttaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcaatttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacgacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgctgtgttttcttcttgtggntgnatatatcaggtaaaatattttccaaagagccatgtgtcatgtaatactgaaccctttgatattgagacattaatttggacccttggtattatctactagaataatgtaatactgnagaaatattgctctaattctttcaaaatggtgcatcccccttaaaangttctatttccataaggatttagcttgcttatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttaaaaaaaaaaaaaaaaaaaaaaaaaaaaaaaaaaaaaaaaaaaaaaaaaaaaaaaaaaaaaaaaaaaaaaaaaaaa

SEQ ID NO: 260 - protein, 2261 aa, Homo sapiens [sequence omitted]

SEQ ID NO: 261 - DNA, 1555 bp, Homo sapiens
attacaggcatgagccaccgcgcctggcccaaacatcagttttgaaagtagggctacagtgatttatatgtattgtgggcacttattaatgtaacgataataaaacatgaatcgtataaagtcctttgagggaatctcctaatggctaggctctctgtcgtaagtcatattccagccccaggcttctgagctcttataacatacaactgagcattcttaagctcacaacctatttccagaaaagagacccacatctttctatgttttatactacctttgtttttacaccatatagtttttttctattagtttaaggtacctagtgttacaggtctagaaagtgcagagccatccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaaggggttatttcacctctactcatgaggatggccagtttttctgtcttttatctttagacccatatataatcagttcagagcacaaatcaaaataaactggcctaaataactgaattctaggaagcaaagctacatcttttttcatatgccaaagcttctgtttcctcatgttgttcctactttttaaataataaatggctctcagcatcttaggaactagatgggtcccatctgggtagaacctgctataatttttagaatcactcttgtaattcttacctcacttaaaatattaggaaacacagtaatagaaaagacagggagaactcgtctgcaggttttggcagtgaaatttgtcttccagtgaattgctattattttcaaattgcctatagtcaaaaagcttttccattgatggagacttactttcaaatgagcttgtgttgaattcagcactctagattctctctgacattttcctgtcttttgggaaaaaaaagcagatattccaaaaatggcagaaatctaatttttgtaaactttttcatctataggattgagccaaaaaacatacatactattttaaagaaaggtaccatctaattcttttattaaagatagctacttctgaaatgtcttaacagagtttcaagattgcaaagtagtattgcatagctggttttcttacatgtgatgatggaggagagaggaagacccagacttaggcatgtagtgaaatatgtacagtttctggcatcagtgtactatttatagtctatagcatacattacttgcaaatgggaaaagtattttataattatttttgtacctcaaaataattattatattctactgtattatattcaaattaaagtttattatttgatcttagatgatatctgtgaggtgtgatgagggtgggacctaagtatgtcatgtgctttaaccttttttctagcctaagatgaagggagaa

SEQ ID NO: 262 - protein, 19 aa, Homo sapiens
YRHEPPRLAQTSVLKVGLQ

SEQ ID NO: 263 - DNA, 2147 bp, Homo sapiens
ggctcttttaaatgaccccaggcgtcgtgtattgaatcctagactcacgtccgtctcgccggcgcccgagccagtccgcgcgcaccgcgtctgcgtccccgaaagccccgcccgcaagggctgccctgcctacctggtctccgacgtgctcgtctggagggcggtgcgaggggccgagccgacgagatgttcttgctgcctcttccggctgcggggcgagtagtcgtccgacgtctggccgtagtacgttctgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagttaaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgaaaaaaaaaaaaaaaaaaaaaaa

SEQ ID NO: 264 - protein, 519 aa, Homo sapiens
MFLLPLPAAGRVVVRRLAVVRSGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 265 - DNA, 1523 bp, Homo sapiens
atgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcctcctgccgggccctggtacccgaccccccggggccccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaacc

SEQ ID NO: 266 - protein, 231 aa, Homo sapiens
MKRRRRRRPVAPATAARGGDFRAEDGAGLEAREEKVVYSRSQLSLADSTKALGDAFKLFMPRSTEFMSSDAELWSFLCSLKHQFSPHILRSKDVYGYSSCRALVPDPPGPPTARGQARRPVPRAAARRRRRGARAAAARRRKPRPPPPPPPPPEESCPAKPVAPGPCFGGRTLEEIWRAATPTLTTFPTIRVGSDVWGERSLAAARRRARQVLRVNLEPMVRLRRFPVPRA

SEQ ID NO: 267 - DNA, 1128 bp, Homo sapiens; identical to SEQ ID NO: 196

SEQ ID NO: 268 - protein, 374 aa, Homo sapiens; identical to SEQ ID NO: 197

SEQ ID NO: 269 - DNA, 1776 bp, Homo sapiens
tttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcaaaaaaaaaaaaaaaaaa

SEQ ID NO: 270 - protein, 281 aa, Homo sapiens [sequence omitted]

SEQ ID NO: 271 - DNA, 689 bp, Homo sapiens
gcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccaaaaaaaaaaaaaaaaaaaaaaaaaaa

SEQ ID NO: 272 - protein, 152 aa, Homo sapiens
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGVFALVTAVCCLADGALIYRKLLFNPSGPYQKKPVHEKKEVL

SEQ ID NO: 273 - DNA, 1922 bp, Homo sapiens
gcccctttctttctcctcgtcggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggacgtgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgggaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaaaaaaaaaaaaaaaaaaaaa

SEQ ID NO: 274 - protein, 462 aa, Homo sapiens
MQLRKMQTVKKEQASLDASSNVDKMMVLNSALTEVSEDSTTGEDVLLSEGSVGKNKSSACRRKREFIPDEKKDAMYWEKRRKNNEAAKRSREKRRLNDLVLENKLIALGEENATLKAELLSLKLKFGLISSTAYAQEIQKLSNSTAVYFQDYQTSKSNVSSFVDEHEPSMVSSSCISVIKHSPQSSLSDVSEVSSVEHTQESSVQGSCRSPENKFQIIKQEPMELESYTREPRDDRGSYTASIYQNYMGNSFSGYSHSPPLLQVNRSSSNSPGTSETDDGVVGKSSDGEDEQQVPKGPIHSPVELKHVHATVVKVPEVNSSALPHKLRIKAKAMQIKVEAFDNEFEATQKLSSPIDMTSKRHFELEKHSAPSMVHSSLTPFSVQVTNIQDWSLKSEHWHQKELSGKTQNSFKTGVVEMKDSGYKVSDPENLYLKQGIANLSAEVVSLKRLIATQPISASDSG

SEQ ID NO: 275 - DNA, 5718 bp, Homo sapiens
ggccctcccgacgcgcagagccatggcctcccacctgcgcccgccgtccccgctcctcgtgcgggtgtacaagtccggcccccgagtacgaaggaagctggagagctacttccagagctctaagtcctcgggcggcggggagtgcacggtcagcacccaggaacacgaagccccgggcaccttccgggtggagttcagtgaaagggcagctaaggagagagtgttgaaaaaaggagagcaccaaatacttgttgacgaaaaacctgtgcccattttcctggtacccactgaaaattcaataaagaagaacacgagacctcaaatttcttcactgacacaatcacaagcagaaacaccgtctggtgatatgcatcaacatgaaggacatattcctaatgctgtggattcctgtctccaaaagatctttcttactgtaacagctgacctgaactgtaacctgttctccaaagagcagagggcatacataaccacactgtgccctagtatcagaaaaatggaaggtcacgatggaattgagaaggtgtgtggtgacttccaagacattgaaagaatacatcaatttttgagtgagcagttcctggaaagtgagcagaaacaacaattttccccttcaatgacagagaggaagccactcagtcagcaggagagggacagctgcatttctccttctgaaccagaaaccaaggcagaacaaaaaagcaactattttgaagttcccttgccttactttgaatactttaaatatatctgtcctgataaaatcaactcaatagagaaaagatttggtgtaaacattgaaatccaggagagttctccaaatatggtctgtttagatttcacctcaagtcgatcaggtgacctggaagcagctcgtgagtcttttgctagtgaatttcagaagaacacagaacctctgaagcaagaatgtgtctctttagcagacagtaagcaggcaaataaattcaaacaggaattgaatcaccagtttacaaagctccttataaaggagaaaggaggcgaattaactctccttgggacccaagatgacatttcagctgccaaacaaaaaatctctgaagcttttgtcaagatacctgtgaaactatttgctgccaattacatgatgaatgtaattgaggttgatagtgcccactataaacttttagaaactgaattactacaggagatatcagagatcgaaaaaaggtatgacatttgcagcaaggtttctgagaaaggtcagaaaacctgcattctgtttgaatccaaggacaggcaggtagatctatctgtgcatgcttatgcaagtttcatcgatgcctttcaacatgcctcatgtcagttgatgagagaagttcttttactgaagtctttgggcaaggagagaaagcacttacatcagaccaagtttgctgatgactttagaaaaagacatccaaatgtacactttgtgctaaatcaagagtcaatgactttgactggtttgccaaatcaccttgcaaaggcgaagcagtatgttctaaaaggaggaggaatgtcttcattggctggaaagaaattgaaagagggtcatgaaacaccgatggacattgatagcgatgattccaaagcagcttctccgccactcaagggctctgtgagttctgaggcctcagaactggacaagaaggaaaagggcatctgtgtcatctgtatggacaccattagtaacaaaaaagtgctaccaaagtgcaagcatgaattctgcgccccttgtatcaacaaagccatgtcatataagccaatctgtcccacatgccagacttcctatggtattcagaaaggaaatcagccagagggaagcatggttttcactgtttcaagagactcacttccaggttatgagtcctttggcaccattgtgattacttattctatgaaagcaggcatacaaacagaagaacacccaaacccaggaaagagataccctggaatacagcgaactgcatacttgcctgataataaggaaggaaggaaggttttgaaactgctttatagggcctttgaccaaaagctgatttttacagtggggtactctcgcgtattaggagtctcagatgtcatcacttggaatgatattcaccacaaaacatcccggtttggaggaccagaaatgtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctatcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcggccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattggttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgttttgttttgctttgtttttgttgttgttgttttgagacagggtctcactgtgtcccccaggctggagtgcagtggcacaatgacgactcactgcagcctcaacctctggggccaagtgatcctcccacctcagcctctcaagtggctgggaccacagaagtgcaccaccatgcctggcttttttttttttttttttggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttggaacaaaaaaaaaaaaaaaaaaa

SEQ ID NO: 276 - protein, 747 aa, Homo sapiens
ALPTRRAMASHLRPPSPLLVRVYKSGPRVRRKLESYFQSSKSSGGGECTVSTQEHEAPGTFRVEFSERAAKERVLKKGEHQILVDEKPVPIFLVPTENSIKKNTRPQISSLTQSQAETPSGDMHQHEGHIPNAVDSCLQKIFLTVTADLNCNLFSKEQRAYITTLCPSIRKMEGHDGIEKVCGDFQDIERIHQFLSEQFLESEQKQQFSPSMTERKPLSQQERDSCISPSEPETKAEQKSNYFEVPLPYFEYFKYICPDKINSIEKRFGVNIEIQESSPNMVCLDFTSSRSGDLEAARESFASEFQKNTEPLKQECVSLADSKQANKFKQELNHQFTKLLIKEKGGELTLLGTQDDISAAKQKISEAFVKIPVKLFAANYMMNVIEVDSAHYKLLETELLQEISEIEKRYDICSKVSEKGQKTCILFESKDRQVDLSVHAYASFIDAFQHASCQLMREVLLLKSLGKERKHLHQTKFADDFRKRHPNVHFVLNQESMTLTGLPNHLAKAKQYVLKGGGMSSLAGKKLKEGHETPMDIDSDDSKAASPPLKGSVSSEASELDKKEKGICVICMDTISNKKVLPKCKHEFCAPCINKAMSYKPICPTCQTSYGIQKGNQPEGSMVFTVSRDSLPGYESFGTIVITYSMKAGIQTEEHPNPGKRYPGIQRTAYLPDNKEGRKVLKLLYRAFDQKLIFTVGYSRVLGVSDVITWNDIHHKTSRFGGPEMYGYPDPSYLKRVKEELKAKGIE

SEQ ID NO: 277 - DNA, 1155 bp, Homo sapiens
caaaaagaaaaaaaaacaaggttaaaagagaaagggagtaactgcaaaatggcagagctgtctgatcccaaatgacacttgttctctctgctgctgggcaccttcacgctttcctatgggtgtcacccacctcccaccctgaggtattccacctcctacctggatgcgagcagcagtttccctgcgggaaatcctccttcagggcagcttcacggcggctcactagcccctccagcagcgccagggtgtcctcgtggctcaggccaccaccacctccctggccaggagccccttgccgcagctccagacgttccagccgcatggcctccttctgccagttggaggaaaattcagcagcaagagcttccagacgccgctccagagagtgtacccgggacataacacgctgctcagcctggaagggcagagagagagccacggagtgagggacccttggatgatagtgcttcccaaagaccaccccgacacagccaacacagaaagaaagggaaaagattccagagacgttccagcataaggccatgcagggccggctggagctcgtgggcaggggctgccgacctctgagctgggtgtgctgggagccagggatcactgggtgccggccacagaggaaggtccctgaggacacagtaccgaagtctgatcccagaggaggaaggaaggtgggccggggagaaggtctgagtgcagggatggtccaggaggaggactggaagctgcaggatggctgcagggggccgtggaccctcctggcctgaagctcactccttccccgcctcctacaggggcaggggagccagggctgcgagttctgtctgtggactctcaatggctttcactccttccctaggtaactatggctaagagacagaataatttgaaaatacgttctttttcctctttagctggatgtcccacagagaaaatggaataaatgtcatttggactgagggtggcatttgatagtgtgtcatgaatttgagaatgttgttggcttaacaacaaaatcattgccaagagaagtgataaaaactgtcaaataaaggccagggagctactgagcagcagaggttctgagttttagaaattctggtttttaaataggcgctacatttgcatgactcaaaaagc

SEQ ID NO: 278 - protein, 124 aa, Homo sapiens
MTLVLSAAGHLHAFLWVSPTSHPEVFHLLPGCEQQFPCGKSSFRAASRRLTSPSSSARVSSWLRPPPPPWPGAPCRSSRRSSRMASFCQLEENSAARASRRRSRECTRDITRCSAWKGRERATE

SEQ ID NO: 279 - DNA, 776 bp, Homo sapiens
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctagagctgagtgcctgaggggtccagaagcttcgaggcccagcgacctcggtgggccagtggggaggagcaggagcctgagccttgggaaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagcacgctcttttaaaaggt

SEQ ID NO: 280 - protein, 92 aa, Homo sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 281 - DNA, 1935 bp, Homo sapiens
tctagacagtggcgcaagagactggggttgcactgggactccaggaaaggcttagctgttgacgaaggaccggggcggggccggggggcggggcgaaggccaggatctccaggtacccggaaccccaaggggcgggtgtagcaggcaatcttggcgaaactgggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggccccctcccctgactatcaaagcagcggccggctgtttgggtccaccacgccttccacctgccccactgcttcttcgcttctctcttggaaagtccagtctctcctcggcttgcaatggaccccaactgctcctgcgccgctggtaaggaacgccgggttccgtgcctggggatgctcgattcccagacaccatagagagtgttcctgggtttgagaaggtcgtattttgagatctcaactgtaggggactccttgacttagtccagtgctttcctcttggccaagatcctgagagcatttccttcctctctgtgcctctgtgtcagcgttgagggtactgaggctcaaggctgtcctgctccacgtcatgcggtttgtcccagggctgttggctgagccccagtgctctgaccaggctttgagcagcaggattagataggaggcaggggacattgcctcttcggggttcaggacagaaagtcgaagtcgccgtcttcccaggctgtgcctggagcctgggactttcctttggagtgcaaacaggaggctgcttggccttcccagcatgaagggagaggacatggggcttctcttcctctgctctgagtgggaaaggagctctgagggctggccccgcacagaggagggggcaatggagactcattaactcactgctgtacctcctgcaggtcactcgccgctcactggcttttttttctctttctcgcaggtgtctcctgcacctgcgctggttcctgcaagtgcaaagagtgcaaatgcacctcctgcaagaagagtgagtgtgaggccatctccatggtctggggctgtggctaaggttgggatggaacccaaggctggccctgagtgcatgcttctggggaactggccttcctttgtccccgtaggttgtcactgcctttctagtcttctgccctgtgcagggcgcctgggcagctttctcataggaagacccaccccagatatttcccagttgtctcctgacaaagccataccctcctgaactgagggtcctttgtggctggaggctctgttgggggcctctgttggggagggaggtccctgggcaagttggctgtgacctctcatgctcctcttcttccccaggctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctgattctgacttcagtttcccttatgtgcttcagaaatcagagactggggtgggggatcgaactagggttgcagactcctgggctctaaatggaaatctgagtccctaacaatcagagtgcattaaggcaagccaggctgcctcactgtgcttcctcttctgtagaatggaataacacttcatcaggtcattggtggggatcc

SEQ ID NO: 282 - protein, 61 aa, Homo sapiens
MDPNCSCAAGVSCTCAGSCKCKECKCTSCKKSCCSCCPVGCSKCAQGCVCKGASEKCSCCD

SEQ ID NO: 283 - DNA, 1339 bp, Homo sapiens
gaattccgattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagataataaaacggaattc

SEQ ID NO: 284 - protein, 323 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 285 - DNA, 7204 bp, Homo sapiens
gccccagcactcgccggcggcagtgaaaggacgcgccggagccggataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaatcattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgag

SEQ ID NO: 286 - protein, 1925 aa, Homo sapiens
RNSGDSDMEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKIIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 287 - DNA, 2961 bp, Homo sapiens
aagagatgatttctccatcctgaacgtgcagcgagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatggaaattatccagcaagctttcattaacgtggccaaaaaacattttggcgaatttttcaaccttaaccaaactgttcagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgt

SEQ ID NO: 288 - protein, 715 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSVLEALSGVALPRGSGIVTRCPLVLKLKKQPCEAWAGRISYRNTELELQDPGQVEKEIHKAQNVMAGNGRGISHELISLEITSPEVPDLTIIDLPGITRVAVDNQPRDIGLQIKALIKKYIQRQQTINLVVVPCNVDIATTEALSMAHEVDPEGDRTIGILTKPDLMDRGTEKSVMNVVRNLTYPLKKGYMIVKCRGQQEITNRLSLAEATKKEITFFQTHPYFRVLLEEGSATVPRLAERLTTELIMHIQKSLPLLEGQIRESHQKATEELRRCGADIPSQEADKMFFLIEKIKMFNQDIEKLVEGEEVVRENETRLYNKIREDFKNWVGILATNTQKVKNIIHEEVEKYEKQYRGKELLGFVNYKTFEIIVHQYIQQLVEPALSMLQKAMEIIQQAFINVAKKHFGEFFNLNQTVQSTIEDIKVKHTAKAENMIQLQFRMEQMVFCQDQIYSVVLKKVREEIFNPLGTPSQNMKLNSHFPSNESSVSSFTEIGIHLNAYFLETSKRLANQIPFIIQYFMLRENGDSLQKAMMQILQEKNRYSWLLQEQSETATKRRILKERIYRLTQARHALCQFSSKEIH

SEQ ID NO: 289 - DNA, 2156 bp, Homo sapiens
ggcacgagcccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatgggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaaaaaaa

SEQ ID NO: 290 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 291 - DNA, 2774 bp, Homo sapiens
tcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttaaaaa

SEQ ID NO: 292 - protein, 336 aa, Homo sapiens
MLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQDQLQKWIRGNVSACANSVFIFDEMDKLHPGIIDAIKPFLDYYEQVDGVSYRKAIFIFLSNAGGDLITKTALDFWRAGRKREDIQLKDLEPVLSVGVFNNKHSGLWHSGLIDKNLIDYFIPFLPLEYRHVKMCVRAEMRARGSAIDEDIVTRVAEEMTFFPRDEKIYSDKGCKTVQSRLDFH

SEQ ID NO: 293 - DNA, 879 bp, Homo sapiens
gcggagtctccaactgggagagctgcagctgccgagaggaggagaacgctgaggtcggtcggaccaacggacgcgctgaccgctgccaactgcagctcgcgctgcctcctgctcgcgccgtgccactaaggtcactcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctcctaggaactgtgggagaccagcggagtgggagggagacgcagtagacagagacagaccgagaaggaagggagagacagagggggcgcgcgcacaggagcctgactccgctgggagagtgcaggagcacgtgctgttttttatttggacttaacttcagagaaaccgctgacatctagaactgacctaccacaagcatccaccaaaggagtttgggattgagttttgctgctgtgcagcactgcattgtcatgacatttccaacactgtgtgaattatctaaatgcgtctaccattttgcactagggaggaaggataaatgctttttatgttattattattaattattacaatgaccaccattttgcattttgaaataaaaaactttttataccaaaaaaaaaaaaaaaa

SEQ ID NO: 294 - protein, 103 aa, Homo sapiens
METVQELIPLAKEMMAQKRKGKMVKLYVLGSVLALFGVVLGLMETVCSPFTAARRLRDQEAAVAELQAALERQALQKQALQEKGKQQDTVLGGRALSNRQHAS

SEQ ID NO: 295 - DNA, 1466 bp, Homo sapiens
gccctctagggtagaatcgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgttctcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggaggacagggagatgctcgagttccaaaagagaaggtttcttccagagtcatctacctgagtcctgaagctccctgtcctgaaagccacagacaatatggtcccaaataaccgactgcacctgctgtcttcagctcttcttgacatcaaggctcttccgttccacatccacacagccaatccaattaatcaaaccactgttattaacagataatagcaacttgggaaatgcttatgttacaggttaccgttgagaacaatcatctaaatctatatgatttcagaaatgttaaaatagactaacctctaccagcacattaaaagtgattgtttctgggtgatttattgatgatttttattttctttatttttctataaagatcatatattactttt

SEQ ID NO: 296 - protein, 303 aa, Homo sapiens
MGILSFLPVLATESDWADCKSPQPWGHMLLWTAVLFLAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLFSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 297 - DNA, 3639 bp, Homo sapiens
ctcgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatggacccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttcttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccagggcattgaatctacagatgtgaggcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagttaaaaaa

SEQ ID NO: 298 - protein, 308 aa, Homo sapiens
LEAPHQPRFCPPAGHSRKMRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 299 - DNA, 2836 bp, Homo sapiens
ccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaattt

SEQ ID NO: 300 - protein, 421 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVLFIDNWRVLHGRECFTGYRQLCGCYLTRDDVLNTARLLGLQA

SEQ ID NO: 301 - DNA, 5705 bp, Homo sapiens
gaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggc

SEQ ID NO: 302 - protein, 1320 aa, Homo sapiens
NLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 303 - DNA, 931 bp, Homo sapiens
gcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaaaa

SEQ ID NO: 304 - protein, 266 aa, Homo sapiens
MLLLTRSPTAWHRLSQLKPPVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDICPDELEKLVQVVRQLEAEPGLPPVQPVFITVDPERDDVEAMARYVQDFHPRLLGLTGSTKQVAQASHSYRVYYNAGPKDEDQDYIVDHSIAIYLLNPDGLFTDYYGRSRSAEQISDSVRRHMAAFRSVLS

SEQ ID NO: 305 - DNA, 542 bp, Homo sapiens
gtctgccctctctgctcgccctgcctagcttgaggatctgtcaccccagccatgaggattatcgccctcctcgctgctattctcttggtagccctccaggtccgggcaggcccactccaggcaagaggtgatgaggctccaggccaggagcagcgtgggccagaagaccaggacatatctatttcctttgcatgggataaaagctctgctcttcaggtttcaggctcaacaaggggcatggtctgctcttgcagattagtattctgccggcgaacagaacttcgtgttgggaactgcctcattggtggtgtgagtttcacatactgctgcacgcgtgtcgattaacgttctgctgtccaagagaatgtcatgctgggaacgccatcatcggtggtgttagcttcacatgcttctgcagctgagcttgcagaatagagaaaaatgagctcataatttgctttgagagctacaggaaatggttgtttctcctatactttgtccttaacatctttcttgatcctaaatatatatctcgtaacaag

SEQ ID NO: 306 - protein, 97 aa, Homo sapiens
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 307 - DNA, 2017 bp, Homo sapiens
atagaattcggcacgaggggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagcctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcattttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcgg

SEQ ID NO: 308 - protein, 392 aa, Homo sapiens
  Unsure 67: Unknown amino acid
RIRHEGRVLRGRGSGWTCSLGFLLRQPPRNLSASIAARKLLTVLGRIRSRVPASHPTVLFSTSERIXPQHRSASGAAQSSSGRRGRPEPLSGEPRLRRRKNPPDATGVCFCPPPPLPLSPGPSLATAPAAEAAAAAALLSTAGAPRPAWLLSPSGRLSSSSRSSPLPSPSSFVTRPRPHPSPAPQLPPAMACGATLKRTLDFDPLLSPASPKRRRCAPLSAPTSAAASPLSAAAATAASFSAAAASPQKYLRMEPSPFGDVSSRLTTEQILYNIKQEYKRMQKRRHLETSFQQTDPCCTSDAQPHAFLLSGPASPGTSSAASSPLKKEQPLFTLRQVGMICERLLKEREEKVREEYEEILNTKLAEQYDAFVKFTHDQIMRRYGEQPASYVS

SEQ ID NO: 309 - DNA, 3113 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtcccataaccctttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaaaaaaa

SEQ ID NO: 310 - protein, 601 aa, Homo sapiens
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 311 - DNA, 2227 bp, Homo sapiens
  Unsure 527,529,545,549: Unknown base
tttctggtctagatccatctgtaccaacaagttcatcactttacagaacgaatctttttatccgtacaggaggttcaaaccatgtctgcctcttcctttgtaatgaatgacctttctatgagctgtgacaaaatttccgaacaattagctaaggatttgggaagagggggtggcaaacggggctttctgttttcctgcctcagcatgaaaacatctgatttatgctttatggaagccttacctccaatccccaactgttaagtcccatgaaaccacagttgctctgggctgatggaaacaaaaggaaacagtatgaagagttccttaatcatttttgaaacaaaaatgttaagggattttaaacatatgattatttttaattttatgccttttcagtactaaacacccatttcattgctgattcctgtctaagaagccattcacgtcagcatggcgatagaaagaatgaaaaaaccctgctgaatcatacagtaattttctttaaagcacatagtagttacataaananatatatataaatatantttngtttataactaacacaaggcaggatcttgtgactctaagagtgcgttttgtcatcaagacaaaacagatgcaagatgcatcactgcattacttccatagagttgtaaaataatccttaatattagaatatttttctgtcacttagcaaaagtggttcagttcattgccgcgcccatcatgttcttgactatttgatccactttttcgtttatgtcaaccccttccctctctggctaaataaagtggatgcagaaagctccttaaatggagatatcgattgccttggaatcacaatcctgattttgaaaattcctcatgaatgaagaaaggaatggcatcccttgagaaggaaagtggttaatatacatactgagctcctaaagtttaaattcaggtactgagtgtacaatttcaccaacattctaacccatgaaacttttacactctgtgccaagaaactgttggcttttgtaaggtacagtgctcaacatttgcagattcaggtctcaagaagcagagatgtctcataagcagcattttcccaacagtttagcatctgtacacatctgccttggtcatcagtccactcacagagtaccatactttatcatcacaagtgtctgacgtgaacgaatgccattttctattccatatattttgctttacaattttaagtatttgatgaagatggtaactttttcctaacttagttaactattaaaaaaaattttgaaaagcaaggtgattgaaggattgtgatgacaatctctttgcagcagctatgtatggtttatgtgaagtatccccacttattcttgtggagcaggtttggtgagacagcagtaaccaaatgacatgccaatattactggtgcaactggtattctacaaatgcataaggaacacatagacgacttccttttaggataaaatgatgcttctttcactaccttttgtggtagctgtggcttccaatagcaactgtttgacagttatataaatcttgcatgtgtattcttagtttgtgtcccttaagtactacttaattctcaagtagtaatgttattcttatacccttcagcgttctattttgattcaaaacaattgattcaaaacaattttgaatcaattttctattttgattcaaaacaattgataattctataaaaaaacataaacactgaattcttcagtgaaccaaagcaacaaataatagagaaaacttcttgaaactggagtgtgggaaaacttcttaacagaactaagagttaaaggtagtgagaagtgtgtggtgtgtgaattctttagtggtaaggggaaatgtgggctaaatccttttctttcatgaaactctcattctattttatatttctggtttgttcttgttcccatgtgagaaaacatacagtttctgaaaattcaaaatggtcatcaatgctttggactttacataattatgtattagagaaggtgcaactgtacattacttaatatactatgaacataatagaataacaaaaaaagataacaaagagatgcaaacttctggataaatcagataaatggtgctacagaggaatttagttatttcagcttaattatttgtaaaaataataatcagtgactaggtaaagatactgaatctcaagaaaaatatcttgacccatttatgtctagtg

SEQ ID NO: 312 - protein, 33 aa, Homo sapiens
FWSRSICTNKFITLQNESFYPYRRFKPCLPLPL

SEQ ID NO: 313 - DNA, 983 bp, Homo sapiens
ggcacgaggcctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggagcatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgcaaaaaaaaaaaaaaaaaa

SEQ ID NO: 314 - protein, 181 aa, Homo sapiens
MAGSREVVAMDCEMVGLGPHRESGLARCSLVNVHGAVLYDKFIRPEGEITDYRTRVSGVTPQHMVGATPFAVARLEILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPRLAVSD

SEQ ID NO: 315 - DNA, 2026 bp, Homo sapiens
attgataatacttttaatgtgttggtaatgatgtttaaaattgaaagatttttaaaataaaaatgatagattttcttactaaaaatgtttttattaaccttgcttttattggaaaaaatcaagcaatatttctttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacgaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttgttaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttggtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaatt

SEQ ID NO: 316 - DNA, 1567 bp, Homo sapiens
cccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaattaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgttaagaaaaaaaaaaaaaaa

SEQ ID NO: 317 - protein, 24 aa, Homo sapiens
MAPRGFSCLLLLTSEIDLPVKRRA

SEQ ID NO: 318 - DNA, 2907 bp, Homo sapiens
gccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattct

SEQ ID NO: 319 - protein, 462 aa, Homo sapiens
MASNSSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 320 - DNA, 798 bp, Homo sapiens
attcggaacagagcaatctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctyacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctc

SEQ ID NO: 321 - protein, 97 aa, Homo sapiens
MNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 322 - DNA, 4289 bp, Homo sapiens
gatcaatactgaggccgcgtcgacccccttgagccgagacccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccgggaacaagaccgtgacctacttgggaaagttcgccttcgactccccttccaactggtgccaggacaacatcattagcctcatgagcgccggcatcttgggggtgcccccggcttcaggggcgctaagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctactacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccccctgccctcccactccttccccttttcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaagtagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcaaaaaaaaaaaaaaaaaaaa

SEQ ID NO: 323 - protein, 387 aa, Homo sapiens [sequence omitted]

SEQ ID NO: 324 - DNA, 3317 bp, Homo sapiens
ccccagcgaggctccgggagcccttgcctgcgggggtccggggactcgagccggcctccgccccccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcatggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgta

SEQ ID NO: 325 - protein, 372 aa, Homo sapiens
MRVGPVRSAMSGASQPRGPALLFPATRGVPAKRLLDADDAAAVAAKCPRLSECSSPPDYLSPPGSPCSPQPPPAAPGAGGGSGSAPGPSRIADYLLLPLAEREHVSRALCIHTGRELRCKVFPIKHYQDKIRPYIQLPSHSNITGIVEVILGETKAYVFFEKDFGDMHSYVRSRKRLREEEAARLFKQIVSAVAHCHQSAIVLGDLKLRKFVFSTEERTQLRLESLEDTHIMKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 326 - DNA, 1409 bp, Homo sapiens
agatggagtcttgctctgtcacccaggctggagtgcagtggtgtgatcttggctcactgcaacctctgcctcccaggttcaagcaattctcctgccttagcctccagagtagctgagaatacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttacttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttgtatataactttaaaagaggtagaaatatttttagttataattacatttaaagtatacttttttctttgaaaaaattacaaaatttttaaaaagtgaatgatgtaattcaactcaaattacttcatgcttttcattctattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatctttttactaactacttttatgtaataaaatgcagcacatttaaaaaattttagattattgtgaacttaattttttaattaaactttttttttaacatgttaagaccaatggtgcattcagtgaagtattatcatgccataattcaactattccaccttactcaagggtgtgggtaaaagatagtaaccaatgtactattaataacagagtggctaacatctctaataattctcttgcaaggactttaactaagaacttattaagaacattggtccataggtaaattta

SEQ ID NO: 327 - DNA, 2709 bp, Homo sapiens; identical to SEQ ID NO: 255

SEQ ID NO: 328 - protein, 729 aa, Homo sapiens; identical to SEQ ID NO: 256

SEQ ID NO: 329 - DNA, 515 bp, Homo sapiens
  Unsure 269: Unknown base
gtttgaaacgtacctgcatgcaaactattctaggacaactcaagttttagctgctctgtgtgcgttgtgtatgggagtcatctgaagtgtttttcctgtgttgttcacaacccgttaagcccctgggataaagctgattaaaactgggattccccagggtacccccgtccagcctgttagccaagttacaagcttttctcagagaagccccccgggcttgtgcccaccagcattctgctctgtccgggtgagtaactcatatttctttntttctcctttttttttctcctaaactttccaggtaaaagtacacctgtaaggccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctcttttggca

SEQ ID NO: 330 - protein, 129 aa, Homo sapiens
MRSSSWRGPSGRARRRNRRGWRGCGGRSRRTWNWPSRSARLTCLPPRRGPCVGGTGHGRVPERGQCRCLYIHTHTVATVLQGPGLGGLFRVSRLGCKTWKGHISWGSPYRGLGHHFCRSVSPLCHPPRG

SEQ ID NO: 331 - DNA, 902 bp, Homo sapiens
ccttgagctcctcctcgcccttctccaaccggcctcccctgccgcctacccccagcagggccttggatgacaaaccccctccaccacctcctccagtgggcaacaggccctcctcctcctcagaacaacaagcctccagtgccttccactccgcggccttcggcctcctcacaggccccaacttcggcggccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggtatgacaagacgtggagtgagttgcttccaaaacccagcctgcccaaatgtaccaataatcctgtcagtcaagatagtctaacaaaagcaggcataagtaaactcagactgctttgtgcttttaagtggcacacgacacgtgtgatcgtgacctcgtgtaaaccccgggggaaagtgggaccaatatttctgttggtgttttagagatgaggacactgagtagctaataaagttaaatggtcacgagctagttaataaagaagaggcaagaactttcatcttccatctctgaagtgtacttgccagtccactaccctgcctccctagagagaatttcggcggtcttaattgggaaaataagtccccacctcccgcaggagggctctgttattccaacaagaggggaagttcttcaagagctaatgaacttctcctgtacttctctcttcattcgccaggctttgaggccatttccctattcattaaagactaatgtttaaaaagtcaaaaaa

SEQ ID NO: 332 - protein, 121 aa, Homo sapiens [sequence omitted]

SEQ ID NO: 333 - DNA, 885 bp, Homo sapiens
agcctacgcacgaaagtgactagggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctct

SEQ ID NO: 334 - protein, 175 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWENGFVKKFEPKSGWMTFLEVTGKICEMLSLLKQYC

SEQ ID NO: 335 - DNA, 1879 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcgtttgtaattgtaaagcctcaaaagacaactgttcctactatgtaattatagacagaaataaaaacttcagatc

SEQ ID NO: 336 - protein, 480 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 337 - DNA, 1374 bp, Homo sapiens
gagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggaaaaaaaaaaaaaaaaaaaaaaaaaaaaaa

SEQ ID NO: 338 - protein, 219 aa, Homo sapiens
MNRLFGKAKPKAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 339 - DNA, 2941 bp, Homo sapiens
aaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaaggtgtaatacataaattgtcacaaattatacctgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttctgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttaaaaaaaaaaaaaaaaaaa

SEQ ID NO: 340 - DNA, 2633 bp, Homo sapiens
aaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatgcatacatacaggtatgtatatgtaatggttatatgtactcatgttcctggtgtagcaacgtgtggtatggctacacagagaacatgagaacataaagccatttttgtgcttactaccaaaggctgtccactgtagagttgctgtatgtagcaatgtgtatccactctacggtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaaaaaaaaaaaaaaaaaaaaa

SEQ ID NO: 341 - DNA, 2676 bp, Homo sapiens
ctctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctatttttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaa

SEQ ID NO: 342 - protein, 304 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRIEDLGVVVDCLPVLTNCLQEEKQYISLGCCVDLLPLVKSLLKSKFEEYVIVGLNWLQAVIKRWWSELSSKTEIINDGNIQILKQQLSGLWEQENHLTLVPGYTGNIAKDVDAYLLQLH

SEQ ID NO: 343 - DNA, 3089 bp, Homo sapiens
gggggccctccgcaggttcagtcctcgcgtcggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagtgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttaagtcagcactgatgccaccctctcagtggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgc

SEQ ID NO: 344 - protein, 225 aa, Homo sapiens [sequence omitted]

SEQ ID NO: 345 - DNA, 1478 bp, Homo sapiens
aggagagaaacccaaagaaggggtgccagacagctctgtgcaacctcttagcccatgagtgggatagataccactgctgctttaaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcacgcttgcaggttttgaccagagtcagtgttggttagagtaagagaatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccccaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccata

SEQ ID NO: 346 - protein, 58 aa, Homo sapiens [sequence omitted]

SEQ ID NO: 347 - DNA, 404 bp, Homo sapiens
tagagtatttaggatatttactgcaacattgtttataatagcaaaaaagaaatactagaaaaagcttcactgtacagcaacaaatggttaaatatataatgtataatctatacaatagcatgcagtaggtctcttaactccacttaacacattcacaaaactccccagggcgcatccctccccattagccacctcccatcatgtcataggtagatatgcaaaatgctatattgaagggccaggtaaatctcagtcaggatggcattacggcatggagagacaagttattatagtacagcacatgcttgattccatgagtcaaactgcatgcttccaagagatagttgtgttcgctcctgtgactatttcatgccagagttgcttgttgacactgtgatttcaat

SEQ ID NO: 348 - DNA, 2431 bp, Homo sapiens
gttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgaaatgtgagttcctcctcttgaaggcctactgtcatccacaaagctccttttttacgggcatcccatttaatattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatcta

SEQ ID NO: 349 - protein, 713 aa, Homo sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYERQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPRGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRSKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLKCEFLLLKAYCHPQSSFFTGIPFNIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 350 - DNA, 2143 bp, Homo sapiens
tcggagctgaacttcctaaaagacaaagtgtttatctttcaagattcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatgttactggctgaagtgcattttctctctacgttagtctcaggtcctcttcccagaatttacaaagcaattcataccttttgctacatttgcctcattttttagtgttcgtatgaaagtacagggacacggagccaagacagagtctagcaaagaaggggattttggaaggtgccttccaaaaatctcctgaatccgggctctgtagcaggtcctcttctttctagcttctgacaagtctgtcttctcttcttggtttcataccgttcttatctcctgcccaagcatatatcgtctctttactcccctgtataatgagtaagaagcttcttcaagtcatgaaacttattcctgctcagaataccggtgtggcctttctggctacaggcctccactgcaccttcttagggaagggcatgccagccatcagctccaaacaggctgtaaccaagtccacccatccctggggcttcctttgctctgccttattttcaattgactgaatggatctcaccagattttgtatctattgctcagctaggacccgagtccaatagtcaatttattctaagcgaacattcatctccacactttcctgtctcaagcccatccattatttcttaacttttattttagctttcgggggtacatgttaaaggctttttatataggtaaactcatgtcgtggaggtttgttgtacagattatttcatcacccaggtattaagcccagtgcctaatattgtttttttcggctcctctccctcctcctaccttccgccctcaagtagactccagtgtctgttattcccttctttgtgtttatgaattctcatcatttagctcccacttataagtgaggacatgcagtatttggttttctgttcccatgtttgctaaggataatggtttccagttctaccgatgttcccacaaaagacataattttcttttttaaggctgcttagtattccatggtatctatgtatcacattttctctatccaatctattgttgactcacatttagattgattccatgtttttgctattgtgaatagtgctgcaatgaacattcgtgtgcatgtgtctttatggtagaaagatttatatttctctgagtatgtatccagtaatagcccattcatttattgcataaaattctaccaatac

SEQ ID NO: 351 - protein, 219 aa, Homo sapiens
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 352 - DNA, 1776 bp, Homo sapiens; identical to SEQ ID NO: 269

SEQ ID NO: 353 - protein, 281 aa, Homo sapiens [sequence omitted]

SEQ ID NO: 354 - DNA, 891 bp, Homo sapiens
  Unsure 647-687,750-795: Unknown base
cgtgctgtagctggttcttacgtccaacctgggggcagtctgcccagatcgcctgcctggcctcgcctctgcccatcagacacttggtgctggaatctccgaggctgggagggactgggagcgccccagttctgtgtcctccccacacagccccttttatgtaacttgactaagatcaagcagttagtaaatggtagaaagaatatttgaatctacctagtgagtctctagtgcatgcttttgtccggtatcctggaaagcctcccacaaaaagctaatctttgccccattcaaaacatgcaccctgaagaagctgtttgtacaggattgggtttattctgttattaagacaaaggcatcatggcctttgggtgagaggcccgtatgtgtttgggatttggcaatcagcattccatctctgtcatcaccattattgagaaaatagatggattggttccctctctgcagtcctgtggagcagttggactgctctctctgctctcaggatgatactgtgagaacaatttaaatatgctaagcacatgtcaggaaacagttttgtggtctttggacactcgctgtagccattccgttccatttcaggtgattttattcatttcatttgtagaataaaataaatccatttnnnnnnnnnnnnnnnnnnnnnnnnnnnnnnnnnnnnnnnnntatacaccactaaagcctcccattaaacccatagaagacttaaagagctaaaagaggctattnnnnnnnnnnnnnnnnnnnnnnnnnnnnnnnnnnnnnnnnnnnnnnattattaggcacggcatcttgttttacacaacgtgtttgatcttcacttcttcttaatatttggtgtttgatcttctcacaagtggttttgcttgc

SEQ ID NO: 355 - protein, 69 aa, Homo sapiens
RAVAGSYVQPGGSLPRSPAWPRLCPSDTWCWNLRGWEGLGAPQFCVLPTQPLLCNLTKIKQLVNGRKNI

SEQ ID NO: 356 - DNA, 1813 bp, Homo sapiens
ccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgcccagaggggtcaacccttctggaaactgtgaagatctgacttcgcccccccccccccccatcttcgggaccaggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccat

SEQ ID NO: 357 - protein, 446 aa, Homo sapiens
MDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 358 - DNA, 1496 bp, Homo sapiens
atttctctgaagattctacatctctacacaagatattcattcttttggtcacctagggatcttctaagtgtgatattactttcagagaattcagacaagtgagaaacaataatgtaggagtcagcaaagcagaattcagagacttcagccaatcactgctgctctgagaggatccagttagagactcagtatcagcggtcagaacttatctcactcctgtgaactttcaggctggacttaaagctgccaagtttcccctgcagggaaggaaacactgcctcccttcagcaggtagctcattagaaagccaaacaggcaaacgatcctggcctctcccgccagctgaccgctcttcagcatccatgcggttgtagtcgtgactttctcagtcacgatcaagggtgattttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcgatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaatgtattctcaattgcctaccaaaaattggtatgattatcatttctgggtctactgatttttcatcatggcaacagaaattgtcattaaatagaattaagatacaactatatatcttattatttaaaaacattcatagacatattcataaagtttgaatttaaagttttatttttgcaattcagttgtatagaaatgttacataaattcctaaatgctcaattcaggtggcatgatttttagaatattatcttcttcaagatgaatacttaggtctacttcagctctgatattctatttttactttcttacttgaagtgagaaaagagaatggtgaattgtattatagcggtaatacattatttttattttagcttagatttacatttatcagtaaaacgtgtcagtgggctgggtgcagtggctcatcctcttatcccacccagatttctatctggttggttagggtagtccatgcctcaaggaaggcggtgcagcttaatttaacatattgttcagtaaagaatcccattgtgtatcataagaatcccttatccttttcgggccctccaccataccagactgaaaagtattccattgtccagaagtagctg

SEQ ID NO: 359 - protein, 33 aa, Homo sapiens
ISLKILHLYTRYSFFWSPRDLLSVILLSENSDK

SEQ ID NO: 360 - DNA, 1489 bp, Homo sapiens
ctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccgatgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagggccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacagg

SEQ ID NO: 361 - protein, 375 aa, Homo sapiens [sequence omitted]

SEQ ID NO: 362 - DNA, 647 bp, Homo sapiens; identical to SEQ ID NO: 194

SEQ ID NO: 363 - protein, 125 aa, Homo sapiens; identical to SEQ ID NO: 195

SEQ ID NO: 364 - DNA, 1937 bp, Homo sapiens
aaactttctctgatctcctctctctctgtgtctgctccaaatgtagacagcaattgtctgggtaggaccagcttataaagaagcatggctttgttaaggaagtcgtattcagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaga

SEQ ID NO: 365 - protein, 192 aa, Homo sapiens
MALLRKSYSEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 366 - DNA, 983 bp, Homo sapiens
gtggaattcatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcaaaaaaaaaaaaaaaaaaaaaaaaaaaaaaaaaaaa

SEQ ID NO: 367 - protein, 180 aa, Homo sapiens
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 368 - DNA, 3173 bp, Homo sapiens
cagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtagggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacagcgagagagagaaagtaaacggcagtaatgcttctcctatttctccaaagccttgtgtgaactagcaaagagaagaaaatcaaatatataaccaatagtgaaatgccacaggtttgtccactgtcagggttgtctacctgtaggatcagggtctaagcaccttggtgcttagctagaataccacctaatccttctggcaagcctgtcttcagagaacccactagaagcaactaggaaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttgggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcgaaaaaaaaaa

SEQ ID NO: 369 - protein, 430 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTDNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 370 - DNA, 2485 bp, Homo sapiens
atggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcgaccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatgagggaggccccgccacatagacccccaacccagcctttccctttggctcggacggtgacgttgtatcttttccttctggcccctgtttaattttctaagctgccttcaaaatgactcgaagtggacagacacttggattgtactgactcctttgggggtggggtgggtgaggagtaggatgctcagcccactccagctccgcacattcgtcctcctaactcgactttcttcctgacaataggccctgcagtctttttgtagcggtactgacgtcttttattccatgtgtggttcctttttttctttttctataaaggctgtactaattttcttcatgcaacgtttcctaaagaccatggccagttttctacagaagctatttttgacaacctcaagtggcattacattttgcagtgaagtagaggaacctagggggacttcttcacaagttagatttcttgaggatcttctgttggaagcaggagaaagtggggggtggggggaagttgtccgaaatgccctctgaattgccggctgcagggtccttgtgctgcgctggttctttgaaagtctcagtgttgatattgaacttaaagagcagagatggagatcagtagcaaggcagtcatttttttaaagcagtaagtaacaagtaagatttggttcccggtttactttctgctgctaaaaaccacgtcagtgacaactgctctctgtattatagcaatcttgaatggaaacatttctgtcaagttgtaagttttaaaagagtaaagtgttttggttagtaatgatgtggagaaaaatacagtattgcatgtgttcgtgtgtatagattgtggttcgaggattgggagggctctgagaagcagagtactacatcaaaattgttttaagtattttttgccaataaaaaattaattttatggaaatggcttgtgctttgagaagcccagttttattctgtcttatgaaactaatttccactttgaaaattgttcttctgttgtttatggtataaatgaatggaatataatgatatcctccttctaggaaacaaagcatttccttaaaatgtttgctaggttaagctgtgctgttctactgatggttgttttaaattaataatgagaactataatttaaataatatttctttgttagacattataatgttaaactgaaagactaaattctgcaagtactatataatatttttggcttataatgctacatttttattaatgtaccttccgttttgaggatttatatctgtatttctctttgcattatacaaatataccagtattttcaaaaaaaatctatgtcgggtgcggagaaagaggtaatgaaatggca

SEQ ID NO: 371 - protein, 375 aa, Homo sapiens
MANASEPGGSGGGEAAALGLKLATLSLLLCVSLAGNVLFALLIVRERSLHRAPYYLLLDLCLADGLRALACLPAVMLAARRAAAAAGAPPGALGCKLLAFLAALFCFHAAFLLLGVGVTRYLAIAHHRFYAERLAGWPCAAMLVCAAWALALAAAFPPVLDGGGDDEDAPCALEQRPDGAPGALGFLLLLAVVVGATHLVYLRLLFFIHDRRKMRPARLVPAVSHDWTFHGPGATGQATANWTAGFGRGPTPPALVGIRPAGPGRGARRLLVLEEFKTEKRLCKMFYAVTLLFLLLWGPYVVASYLRVLVRPGAVPQAYLTASVWLTFAQAGINPVVCFLFNRELRDCFRAQFPCCQSPRTTQATHPCDLKGIGL

SEQ ID NO: 372 - DNA, 5705 bp, Homo sapiens; identical to SEQ ID NO: 301

SEQ ID NO: 373 - DNA, 3002 bp, Homo sapiens
gtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaaggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaattaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattttactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttg

SEQ ID NO: 374 - protein, 811 aa, Homo sapiens
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGIRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 375 - DNA, 1223 bp, Homo sapiens
agctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaaaaaaaaaaaaaaaaaaaa

SEQ ID NO: 376 - protein, 153 aa, Homo sapiens
MMASMRVVKELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 377 - DNA, 4244 bp, Homo sapiens
ccacgcgtccgccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagtcagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgacggctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagtttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacaaaaactaagacctgcttctcagcaaggagtccagatgaagacacaaggtggggcttcaaatccagctctccaaatagggtcccatcccatgtgcaagagctctcagttcaaatccgatcagtccaacccatccacagtcaaacactcccagcctaaacccttccattctgtgccctctcaacctaaatcctctcagacaaaatcctgtcagtcccagccctcccaaactaaaccttctccatgcaaatctactcagcctaagccaagccagccctggcctccccagtctaagccttctcagcccagaccccctcaacctaagtcatcctcaaccaatccttcacaagctaaggcacaccactcaaaagcagggcagaagaggggagggaagcattaaagagctaactccagagatctataaagcatatcctttacccaggccattcctatcatatagtaagcagaagagttgccatgaaagtaaaagactactgtcattagcatgtaaaacaaagaaagatatacatgaccgaattggatatctttgtttgtttgtttgagacagagtttcactcttgttgcccaggctggagtgcaatggcacgatctcggctcaccgcaacctctgcttcctggcttaaagtgattctcctgcctcagcctctcgagtagctgggattacaggcatgcaccaccacacccagctaattttgtatttttagtagaggcagggtttctccatgttggtcaggctggtcttgaactcccgacctcaggtgatccgcccacctaggcctctcaaagtgttgggattacgtgtgtaagccacagtgcccagcccgaattggatatctttaagatatctgtaagtgttatatccctaaccaagaagaaaaatatgaaaataattaagactagaatcaagcagtagataattgaatccaatcttgggtattattagataatgtataacttgcacccagggaatgggggtctatgagacaaccccacttggagaagaatggggttagggtctctaattgcaaagtgactgtacaataggacgaaagttgcctctgtgtctgagaaagtatcttagttgttggctgctccagaggtatctttgtcaaaagcttctggttcaatatcagccactgagcagataaccctgcttatttggtgtggttaaatcaactagcttctgctaatagccccaatttgcttgaatgggaaaactctctcatttgacccttataggtagaaataatgaattaacaaccaataaaattaatcatttggcattaaaaaaaaaaaaaaaaaaaaaaaaa

SEQ ID NO: 378 - protein, 1037 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKMPVISFVRLGYCSFSKSRILNTLLSPAQLKLHKIFLHQDLPLLVLPRQISDGLVEITWCFPDSDDRKENPFFQKPVALANLRGNLESFWTQFGFLMEVSSAVFFFTDCLGEKEWDLLMFLGEAAIERCYFVLSSQARESEEAQIFQRILNLKPAQLLFWERGDAGDRRKNMEGLQAALQEVMFSSCLRCVSVEDMAALARELGIQVDEDFENTQRIQVSSGENMAGTAEGEGQQRHSQLKSSSKSQALMPIQEPGTQCELSQNLQNLYGTPVFRPVLENSWLFPTRIGGNFNHVSLKASWVMGRPFGSEQRPKWFHPLPFQNAGAQGRGKSFGIQSFHPQIFYSGERFMKFSRVARGCHSNGTFGRLPRPICQHVQACPERPQMMGTLERSRAVASKIGHSYSLDSQPARAVGKPWPQQACTRVTELTEATGKLIRTSHIGKPHPQSFQPAAATQKLRPASQQGVQMKTQGGASNPALQIGSHPMCKSSQFKSDQSNPSTVKHSQPKPFHSVPSQPKSSQTKSCQSQPSQTKPSPCKSTQPKPSQPWPPQSKPSQPRPPQPKSSSTNPSQAKAHHSKAGQKRGGKH

SEQ ID NO: 379 - DNA, 631 bp, Homo sapiens
caatacagctaaggaattatcccttgtaaataccacagacccgccctggagccaggccaagctggactgcataaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgaagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaa

SEQ ID NO: 380 - protein, 117 aa, Homo sapiens
MRASSFLIVVVFLIAGTLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 381 - DNA, 2303 bp, Homo sapiens
agcttccagcacagcccgcggcccggtgccagctccgccggcgaccggtgtgccaaagtgcggtgctcccgcagggaacctggctcggggagggcctccaggtgagtgccgggctcggcgctctgctcctggagctcccgcgggactgcctggggacagggactgctgtggcgctcggccctccactgcggacctctcctgagtgggtgcgccgagtcatggagggcgcagagctggccgggaagatcctttccacctggctgacgctggttctcggcttcatccttttaccttcggtcttcggagtgtctctgggcatctccgagatctacatgaagatcctagtgaaaactttagagtgggccacaatacgaattgaaaaaggaaccccaaaggagtcgattcttaaaaactctgcttctgttggtattatccaaagagatgagtcacccatggaaaaagggctctctggtctacgaggaagggactttgagctgtctgacgtgttttatttctccaagaagggattggaagccattgtagaagatgaagtgacccagaggttttcctcagaggagctagtgtcatggaatctcctcacaagaaccaatgtaaatttccagtacatcagtctgcggctcactatggtgtgggtgctgggcgtcatagtgcgctattgtgtcctactgcctctgagggttaccttggctttcattgggatcagtttgctggttataggaactacactggttgggcagctgccagacagcagcctcaaaaactggctgagtgaactggtccatctgacttgctgccggatctgtgtgcgagccctctctggtaccattcattatcataacaagcaatacagaccccagaagggaggcatttgtgttgccaaccatacttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagagactaaaagaacatattgctgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttcgaatgatgaccagctgggccatcgtctgtgacgtgtggtacatgccccccatgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggctttttttgttttgttttgttttattgttttgtttttattattgttaatcttttctacagaatgattgtctctacctctttatgccagaggcagaacctacaggtgccctttttggcttttgttgttgttgtaacattagccccatggattgtaaggtggtttactgagttaaaacagattctgcttttgtaaaatgatggcatcactgtggactgaatgaaatatttgtatagaaaaaagtgcttgaaaagtgtgtttggaactcatcgatagggtaattctccaaaaatgcccaaactctttttctgtaattagccttgccactttcttcagtcacttaaatggtgagattacacatcagtgcaagatgaccattatggttatggtctactgcaaggttgaaaggaaaaatggaggattgtatttaggaaaagggacaactttgtggccacctgctctgaaagtcaaaaggaaatgtaaattagtgtcattagtgtgttggaagagaaatactattcagtaagcttcgccaaagaaaagtgagtcaaagttaatgtgtgtgcgcatttatatgtaggcagctcgtagaccacattttaaccagcaactggtaacaaagagcttagttttccttgtttgaatgctgtagatctgtacctagtacccctcccatctactgatttgtttgtttttgtaaccaaacacattttcagatagaaggagcctt

SEQ ID NO: 382 - protein, 434 aa, Homo sapiens
MEGAELAGKILSTWLTLVLGFILLPSVFGVSLGISEIYMKILVKTLEWATIRIEKGTPKESILKNSASVGIIQRDESPMEKGLSGLRGRDFELSDVFYFSKKGLEAIVEDEVTQRFSSEELVSWNLLTRTNVNFQYISLRLTMVWVLGVIVRYCVLLPLRVTLAFIGISLLVIGTTLVGQLPDSSLKNWLSELVHLTCCRICVRALSGTIHYHNKQYRPQKGGICVANHTSPIDVLILTTDGCYAMVGQVHGGLMGIIQRAMVKACPHVWFERSEMKDRHLVTKRLKEHIADKKKLPILIFPEGTCINNTSVMMFKKGSFEIGGTIHPVAIKYNPQFGDAFWNSSKYNMVSYLLRMMTSWAIVCDVWYMPPMTREEGEDAVQFANRVKSAIAIQGGLTELPWDGGLKRAKVKDIFKEEQQKNYSKMIVGNGSLS

SEQ ID NO: 383 - DNA, 2114 bp, Homo sapiens
aaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaagtggatgtgaaatattgtccttgcctatagatctcaaaatctagtactaattgttggttgttaatatgattcatacaatagacatttgttaaaccagcttttgagtggagaaaattattttccatttaaacagtacagtgatgatagctatcaaacaggtatactaaaaagtcagtgactgtgacagtttaaagtgttagacaaatgatgtataaggttctttagtaaggaaagattagccaaaaattttttacccagctagaagcttttaaatctacacttgatatctctgttctaggtaaaattcaaacaaccaaaaaacagtggcccatctgtagcttatgaatctatttaaaattgaatattttatgttgacttctttcatactagctgaaacttgctctaaagagcttcctttggaatctttagatttctttttataaggttcaattcagtacatccataaatcgacagaatgaagaaaacataacaaaaagccacctattccttcctcttgctcccttattagctaaagtaaaatttacatctgtaagacttactgagttgctgccaaaatggaactgaattcttaaaagaggaacatgcctatgtgaaacattagaaaaccaaaataaatgggaaaattcagacttgaagagctgaatcatgtgacaacaaagtactgatcttaattcagaaaggctacttggagaaggtgtatcttaaggggtaaaaaacctgtgggttaccacatattaacagggaataatatcaacagaggcacccataagcaagcaagacacaactgagacagatgtaccaggtgaaaaaaatcttcagtatggatacacatgggtattctgaaggctacaatgaatggtttagtctttgacataaggaggatgaacatattatttatactgtgtaatctaatctggcttctatggggaaagcaacatgtacataagtgaattttctacatgaagtgggctacttctgattttaatcaaagctataaaatagattgtatatttcactagcttcttaaagtaactcttccattttcatttatctctaaaaacagttaacttcctgtgctctaggaa

SEQ ID NO: 384 - protein, 64 aa, Homo sapiens
MHQYQRSMWKYGHVCPYAVWSLDFYICFAFVCSSNLPPFDLWPGKMWFLCISNKSKIVFFEWFT

SEQ ID NO: 385 - DNA, 451 bp, Homo sapiens
aggaccacgcctcctccaagtcccagcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaaaaaaaaaaaaaaaaaaa

SEQ ID NO: 386 - protein, 61 aa, Homo sapiens
MDPNCSCAAGDSCTCAGSCKCKECKCTSCKKSCCSCCPVGCAKCAQGCICKGASDKCSCCA

SEQ ID NO: 387 - DNA, 2876 bp, Homo sapiens
cccatcttagagcagctgaataatttcctgagaattctattcctgaagctaggaagaaaagtttatttatacatacacgcaacctgcaagtctccagtttctattcttccttcctctttgacccttcccctcccccactttgcaccagagaagtcagactccgggagtgctttaacagtttgaaggctaatctgaaagaggaagaagaatctgtatatctgtatatattggctagcaaatgtgccctgctctctcccctcttaaaaatagcagcaacccatctttgcaaagaagcttgcctatagagcaggcactctgtgaatggactgtgcttttacgaccctacagggtatcaagatactgtgcagctcgccaacaaggattaattgcaaggactggtagatcgaatttactgaagacttggagcttgcttctgagaacaaacgcaaaaggacagtaaactgtggaccttgaagttagcagcgtgggcttcctctaatattacaccgtaaaaggcattgatcaccataagaaggaacatttgtgaaggtactccagtgccagaaagaggcacaaagcagacattcgtagagaaacatggatgaaacaggaaatctgacagtatcttctgccacatgccatgacactattgatgacttccgcaatcaagtgtattccaccttgtactctatgatctctgttgtaggcttctttggcaatggctttgtgctctatgtcctcataaaaacctatcacaagaagtcagccttccaagtatacatgattaatttagcagtagcagatctactttgtgtgtgcacactgcctctccgtgtggtctattatgttcacaaaggcatttggctctttggtgacttcttgtgccgcctcagcacctatgctttgtatgtcaacctctattgtagcatcttctttatgacagccatgagctttttccggtgcattgcaattgtttttccagtccagaacattaatttggttacacagaaaaaagccaggtttgtgtgtgtaggtatttggatttttgtgattttgaccagttctccatttctaatggccaaaccacaaaaagatgagaaaaataataccaagtgctttgagcccccacaagacaatcaaactaaaaatcatgttttggtcttgcattatgtgtcattgtttgttggctttatcatcccttttgttattataattgtctgttacacaatgatcattttgaccttactaaaaaaatcaatgaaaaaaaatctgtcaagtcataaaaaggctataggaatgatcatggtcgtgaccgctgcctttttagtcagtttcatgccatatcatattcaacgtaccattcaccttcattttttacacaatgaaactaaaccctgtgattctgtccttagaatgcagaagtccgtggtcataaccttgtctctggctgcatccaattgttgctttgaccctctcctatatttcttttctgggggtaactttaggaaaaggctgtctacatttagaaagcattctttgtccagcgtgacttatgtacccagaaagaaggcctctttgccagaaaaaggagaagaaatatgtaaagtatagtttaaacccatttccagtccaaaccaatgaaaatagtttcccaaataagtattttgtcaaatcatttacaaaaaaaataaaaattttacttaatattttacaaatacttaactatttgggcctacaactctatctcatttatgcatccacatgattagatatttatagatattttaagtgctaaaaattcggtccacaactatgaactgaattataaataattttgaccactcaccagaatttggagaatatttttatctttgcactataaaatatgtcttatattaaagttttcctcttcaaataaaagctttacaaacgataaaatatataaaattagtcaataaaaatacatgcaagctaaaagttataaaatataaaactagatataaaattggcaaatagttctgaatcattctaacatattcctttgcatgcatgccatcagatgagaactggagatgactcaggagctacataaaacgtactgtcacccttctttgtagtactgattcgctaggcaaattagggccatttcttccaaaagagaatgtaaaagtgctagaacagactagtattcagctaaagggtcctaaaagcaccatacaatgttcaatatggcaacaggagaaatctggtcaaaagccagtttgtctccagttttcttctgcctttgcctcaggctcccaaaattgaatagtggagttttagctgctcagtgaggttcctgtagagatttctctccatccatgacatacaattcttccttaagaagccagacaactggcactcctatatataaatagaagtaattaaaaacttatctgaagaagagaaaaggaaaaggaatctacttttctatatgccaattgctgggatcaaaataaactacaaaggatttatgaagaaaattgtgaatgttcacgttacaaattcttttaagaagtgcatacatttatgtatatgtatacaactatatgtaagagattttgctgtatgatatgcattatgggtgaaagttcacgataagttttattattgctttattactttttattggtatgttgacaggaatatcatggatatgtttacagtgacttttatattacagtggacgctttgatcttaaaacagccacaacaactcatctacggctgaaatataatatgcgtggacaagcttttgctgaagtgtagtgtgtcctttaagtttgttttttaaaaagtaacttacctcagaagaaataaatgataactataaagaaa

SEQ ID NO: 388 - protein, 306 aa, Homo sapiens
MISVVGFFGNGFVLYVLIKTYHKKSAFQVYMINLAVADLLCVCTLPLRVVYYVHKGIWLFGDFLCRLSTYALYVNLYCSIFFMTAMSFFRCIAIVFPVQNINLVTQKKARFVCVGIWIFVILTSSPFLMAKPQKDEKNNTKCFEPPQDNQTKNHVLVLHYVSLFVGFIIPFVIIIVCYTMIILTLLKKSMKKNLSSHKKAIGMIMVVTAAFLVSFMPYHIQRTIHLHFLHNETKPCDSVLRMQKSVVITLSLAASNCCFDPLLYFFSGGNFRKRLSTFRKHSLSSVTYVPRKKASLPEKGEEICKV

SEQ ID NO: 389 - DNA, 517 bp, Homo sapiens
  Unsure 72: Unknown base
acccctcactaaagggaacaaaagctggagctcaaggatccttaattaaattaatccccccccccccccggnatgcgcgttgcgcgccggacgcggaacgtctgccggtgtccccgcgctgctggtcccggggtccctgaaccgcgggcggccccgctccctctgctggccatggcccccccgcccgcgtgccggtccccgatgtcaccgccgccgccgctgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggcaaaaaaaaaaaaaaaaaaaaa

SEQ ID NO: 390 - DNA, 7032 bp, Homo sapiens
gccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgcgcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgcgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccaaaaaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaa

SEQ ID NO: 391 - protein, 2000 aa, Homo sapiens
AACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMRLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRD

SEQ ID NO: 392 - DNA, 720 bp, Homo sapiens
cagaaaatgccacagtcctcacctcaataaatgagaggacattgtggcagccaaagccacaacttggaagatggggctgcacctgccaacgaagacgggaaatgaccccccccccagcctagtgtgaacctgcccctcgtcccacgtatagaaaaacctcgagtcatggtgaatgagtgtctcggagttgctcgtgtgtgtgtacacctgcgtgcgtgtgtgtgcgtgtgtgcgcgtgtgttcgtgtatgtgcgtgtgtgcgtgcgcgtgtgtgtgcattttgcaaagggtggacatttcagtgtatctcccagaaaggtgatgaatgaataggactgagagtcacagtgaatgtggcatgcatgcctgtgtcatgtgacatatgtgagtctcggcatgtcacggtgggtggctgtgtctgagcacctccagcagatgtcactctgagtgtgggtgttggtgacatgcattgcacgggcctgtctccctgtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtgtgctcagggcacatgcacacagacattttatctctgcactcacatttttgtgacttatgaa

SEQ ID NO: 393 - DNA, 1589 bp, Homo sapiens
ggcacgaggtgggcgcggtagcgagcgccagcgtgtgcgccctggtggcgggggtggtgctggctcagtacatattcaccttgaagaggaagacggggcggaagaccaagatcatcgagatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatactacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaatcttaaagccaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaaaaaaaaaaaaaaaa

SEQ ID NO: 394 - protein, 286 aa, Homo sapiens
MMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 395 - DNA, 4628 bp, Homo sapiens
cattttctagcacactgcactgtcgtgtagacttgtgggaagaacttttcccgttttcaagctccacgctgcatcacaggaaatgacactgaccagattaagctacaaatacaagtctcgcagccagtctcaaagtctgtaaccccaataacattttttaggtaaataaaaattgttactgggtggtcttcccttctccaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggtgatcccgataaacctgatcctgtgcacggggctttctgccttctcagtgtgtttccctccgtgttaggcctactccagccttgccccgggtgtttgctgtgagcccacagtttctgcggcctcccttacagagagcaagcaagacagcaaatcagcaagttttcttgtagagtaaaagcagattgacatcttgtgggtttgattcttaggaatgatgttgatgcatggccatgcctgctgaagcgggaagtccatggaaccgatttgttcctgctctccgcatgcgggtactgataggtagacctgtgtgtctccatggcctccaggaactgcctgcacaccgtgcgcccaagtgtcagctgttagagagttggccccccgcatgtggcttgggcagtgaaggggctcggctctcttaccaggtggtgagatgccagaaacccagcccacagacatccctctcctgcttttcatttcccaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaaaaatgaattttattttacttgtcacacctgtcttaataaactggagttttgctgctaaagaactcttctctctgggggcagagcttctatttatggcacatagacatcagctaggcttttgggaatcgtttgtgttctttgtggaaatgtcctttagaagcacccatgaagtagtgtgttcagactgtgcacacagaaaacaggctctgccttcacatgtgagacggtggacttttcctctggacaaaatgacagcatcctggcgactccacagtggagctgagcgccactccctgtagccgatctgggactgaaacgcttacacctctgcctcagaaggagtcccccatgccctgcctgaaatgacttcactggacacagcggggctgcagctaacggggtacaggtaggagctaactaacttcacccctgagtccacttgcggggtaagagataaacagtaacccttccaggagcccactgacgttggagtgctaaaaatgccccttcagggggaaaactgcattttctcttccaaaaaggaaaggttcttccaggcgagaaacctgtggtctagaaccacagcaagaagaggaggcatgctggcctgcaccggaagactcactttgtctgccctgcgccagcctcacctcaccctgcagttcccgtttccgccatggatgcctcatcaccaaccctgaccttccccctcccaaccctttattcatcctcactcccactcatacccgcctccctggacagttccctgctgcagagttctttctgctttcagccctaccttggtggtgatttacctgaaaatcttcacaactgatcattatctccttctctttgagacctgactgaaaaaattaggtgtgcacacctgta

SEQ ID NO: 396 - protein, 224 aa, Homo sapiens [sequence omitted]

SEQ ID NO: 397 - DNA, 3495 bp, Homo sapiens
ggggcagtattctgtgttgagggaggaaaaacactcccttccaaaagcatgacaggcagaaagcagagaagggccaggactggctgagggcggggagctgggcctctggggtggacacacccttggtcacattgtgagggtagcttggttggccagtcccaccactgcagtgaccacagttgtgttgggctcacaccagtgaaccgaagctctggattctgagagtctgaggattccgtgaagatctcagacttgggctcagagcaaggatgcgtgaaattgtccatattcagattggccagtgtggcaaccagatcggagccaagttctgggagatgattggtgaggaacacgggatcgacttggctgggagcgaccgcggggcctcggccttgcagctggagagaatcagcgtgtactacaacgaagcctacggtaggaaatatgtgccccgagcagtcttggtggacctagaacctgggacgatggacagcattcgatctagcaaattaggagctctctttcaacccgacagttttgtccatggtaactctggggctggcaacaactgggccaaaggccactacacggagggagccgagctgatcgagaatgtcctagaggtggtgaggcacgagagtgagagctgtgactgcctgcagggcttccagatcgtccactccctgggcgggggcacaggctccgggatgggcactctgctcatgaacaagattagagaggagtacccggaccggatcatgaattccttcagcgtcatgccttctcccaaggtgtcggacacggtggtggagccctacaacgcggttctgtctatccaccagctgattgagaatgcagatgcctgtttctgcattgacaatgaggccctctatgacatctgcttccgtaccctgaagctgacgacacccacctatggggatctcaaccacctagtgtccttgaccatgagcggcataaccacctccctccggttcccgggtcagctcaacgcagacctgcgcaagctggcggtgaacatggtccccttcccccgcctgcacttctttatgcccggctttgccccactcacggcccagggcagccagcagtaccgagccctctccgtggccgagctcacccagcagatgttcgatgcccgcaataccatggctgcctgtgacctccgccgtggccgctacctcacagtggcctgcattttccggggcaagatgtccaccaaggaagtggaccagcaactgctctccgtgcagaccaggaacagcagctgctttgtggagtggattcccaacaacgtcaaggtggctgtctgcgacatcccgccccgggggctgagcatggccgccaccttcattggcaacaacacggccatccaagagatctttaatagggtctctgagcatttctcagccatgttcaaaaggaaagcttttgtgcactggtacaccagcgaagggatggacataaacgaatttggggaagctgaaaataacatccatgatttggtatccgagtaccaacaatttcaagatgccaaagcagttctagaggaagatgaagaggtcacggaggaggcagaaatggagccagaagataagggacattaactgtgagagaagctgtgccgcggagtcgcttacagaacagtttctcattagatgagtgtttctcctgcagcactccaaaacccactctgcactgcagcacagtgaatgatatgcactcaccattagcttcgacacagggactgagggagacaggtggggagcagctgacaggcattagggtctttgctgacatctactaaccttgaagagtttgatgttcagtgcatacttattaacttaaaaaaatagcaaatttattgtaaagtgctccctttgtttcaaagtgtttgccaggcatccagactacacgtgtggatttgcagggagccactggagttggtgttacatttttatactttagcagcactgataggcaccctggaatcctcacttggtatccgagggctactaagactctttccttaggttctttcctctgagcaaacactgactggcatcctgctttccagtgcctgccagcctccagaagagccaggtgcctgactagtacatggggagctacagagccaaggtcaatgtgagtcaacatccactagaaatatccatgttgtgtagacctgtgcatacaacatgctaactggaaaagaggaaaaaagaaaagccacagtcctctccacaaaaatacctggtccaaacaagaaaaacaaaaagacaagcaaaactaaagaactgcagtcttctgatctttatttctgaagagctagcctttaacatatatgtttatatagtttaaatttcttactactgttagatcccaggaattcattaataatcatccttggctttccttttaaaggctattttgaaatggtcttttcactttcattcagtcatcaccccccaaaatgctctgcagcctctctgctctttgagaaagggcacaccatgcgctcggcaaccattcaaatgcaggaattaagcagcaatggctgcagtgtccttctcagttatggaggacatcgtctcattagggaacttttacagttcaaattaatttgcagaagttgccataaatgtttgcataatgacatagctttagcactacatgattttaatctgctcacattataacaggaccaaatacacaagagcgtaatcaaatcatctgtaacttcttaattacagtttacctatttctgacatgcagcactgccatctcttccagcaccatcagggttttaatggccctctagaattaccactgagatacactatttgatccatggataaccggtaatgggaaaatgctccgaccctcaatgcagtaaatatttacttgcaggcaactgggttctcatctcttgatttgcttttgtaatcagcaataataaaatagcaggtagatggatgacagttgctcattctgagaaacttcactcttttcacttatgcatcacgaggaaataactaaaatacataccaagagaaaaataccttgccatcggatcatcaacaagtcttctatttacaaacttcaaaaaacacaaaacaacattcatgttttaaatgctttctacttgtggttcaagaagcactagatttagtaagaaactctacctatatacttagtttgaagttagtaacttcctgagatgctaaagacttacagcctgcgattatacaaggatttacacatgcttcctctggtgctttacttcccaaacctaaaaaagcaatgaaatagatgtaaggaaggagggatttaaaccttttaaaaaacttttgctgacttatattactgtaaagatttgtttgctcaatagtaatcattaaactacaaagtaattcaattttaaatggcaaaattgctttatttcagactaaataaattccttttcttgaagcctaa

SEQ ID NO: 398 - protein, 451 aa, Homo sapiens
MREIVHIQIGQCGNQIGAKFWEMIGEEHGIDLAGSDRGASALQLERISVYYNEAYGRKYVPRAVLVDLEPGTMDSIRSSKLGALFQPDSFVHGNSGAGNNWAKGHYTEGAELIENVLEVVRHESESCDCLQGFQIVHSLGGGTGSGMGTLLMNKIREEYPDRIMNSFSVMPSPKVSDTVVEPYNAVLSIHQLIENADACFCIDNEALYDICFRTLKLTTPTYGDLNHLVSLTMSGITTSLRFPGQLNADLRKLAVNMVPFPRLHFFMPGFAPLTAQGSQQYRALSVAELTQQMFDARNTMAACDLRRGRYLTVACIFRGKMSTKEVDQQLLSVQTRNSSCFVEWIPNNVKVAVCDIPPRGLSMAATFIGNNTAIQEIFNRVSEHFSAMFKRKAFVHWYTSEGMDINEFGEAENNIHDLVSEYQQFQDAKAVLEEDEEVTEEAEMEPEDKGH

SEQ ID NO: 399 - DNA, 2427 bp, Homo sapiens
cggacgcgtggggagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaaaaa

SEQ ID NO: 400 - protein, 263 aa, Homo sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGSTPLMGQAGTPGA

SEQ ID NO: 401 - DNA, 2533 bp, Homo sapiens
ccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgcttctacagtatttcacattgtatcatggaaaaagagccacttaaggacagcggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggcaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttggagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagcggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggagtgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtccaaaccactaatatgtatgtaaaaattgtgctgtatactacaataaagttgttacttggatttgttccaaaaaaaaaaaaaaa

SEQ ID NO: 402 - protein, 238 aa, Homo sapiens
MRFKNRFQRFMNHRAPANGRYKPTCYEHAANCYTHAFLIVPAIVGSALLHRLSDDCWEKITAWIYGMGLCALFIASTVFHIVSWKKSHLRTAEHCFHMCDRMVIYFFIAASYAPWLNLRELGPLASHMRWFIWLMAAGGTIYVFLYHEKYKVVELFFYLTMGFSPALVVTSMNNTDGLQELACGGLIYCLGVVFFKSDGIIPFAHAIWHLFVATAAAVHYYAIWKYLYRSPTDFMRHL

SEQ ID NO: 403 - DNA, 8839 bp, Homo sapiens
gaagcccggcggcgcggccctcgtcccccttcccgacccccggtctgtctcctcgctcccttcagccgccttccgcgccgccgcctctgccgttcgtcaggcggcccggcccggcccgcccgccccgcatcccccccggcgcgctgaatgcagactaatagggatgccaaaggaaaaatatgatcctccagatcctcgcagaatttataccatcatgtcagcagaggaggtagccaatgggaaaaaatctcactgggcagaattagaaatctcgggtagagtgcggagcctaagtacatcactttggtcattgacacacttgacagcgctgcacctaaatgacaattaccttagtcgcattccacctgatattgccaagcttcataatctggtttacctggatctgtcatccaataaactcagaagtttaccagcagaactaggaaacatggtgtctctcagggaattgcttttaaataacaatctgttacgggttttgccttatgaacttggtcggctcttccagctacaaactctaggtttgaaaggcaatcctttatcacaggatattctcaacttataccaggacccagatggaacccgaaagctactgaacttcatgcttgacaatctcgcagttcatccagagcagcttcctccgaggccatggattacattaaaagaacgagaccaaattctgccgtcagcatcattcacggttatgtgttacaatgtgttatgtgataaatacgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaaatgggaaacattgtaaacagcttaagtttattttgtgtatgatcgaggcactctgttgcaggaaggtgtgtaattgggttctctctgcttcaaatgcgctctttcaaaccattcattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatatattcaatgaaagtaaaatgtatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcgtacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttttttggtgtcttaaagttatatattaaatcacagagaagcaagggagaaagttgaaagatatctaaggctcatatcacttgattctatggtagattatattagaattgatcaatttcttcattgatactggaacatgggcaaatatagtgttccatcatgaaattctaagtctatactgttaaatgggtgaaaatttaagtttatatttgcatttccaagcgtttctaaaaatcactaatgccatctatacttttagtatgaaacagcagactatagaaagcacagggaagaataggctaaatacattctttgaagaaccagaggcatataaccacatcattatgtcattcctaatacatggctagattttctaatgataaaattgactgtgtcccaatgcttatttgattctaagcttttttattctgtttctgagatattttaatagctttgcaaaatatgctgaccagtttttggaaaataatggtttttatagcaagcaaagactttatggcacattttcaaaatagcactcatacatacttacattttgacagaaatgtgaattctcacattgatgagatatttttttcccacctgccctaccctttaaaaaaggtcacctttctaatgtgtagtagattcatttacgcctttccctttgagtcataccatgtttggagaactgtgtgaattgtaggtagagaaattaactagggaagccagaagcttgaactaaagttttaaatttgtaggcagatgagaacttttatactatggttgctttgggcgattctaattttgtaatagcatcatgatcaccaaaattaattcaaacattttagtacatctttaatctgtcttatttaccaaagttctaatctgtttaagaacaggatgccaagagcatctttcattttatagaatgatatgctcacctttataagtgtcacctaaaagcttgagggtaaaaaagaagcagcccatatatctaaactacaggatgtcttgaacaagattcacagaaagaaagaaaaaaaagcagttctttccaggaaggtggtaaggaagagcatgcatatttcttgttttaaccaaataccttttttatgtaaatgtctctattaaaccccaggtcctacaccaggaaatagggtgataaccaggaaaataccaagctttaacccagttggcagttccttgtggcatacatttggttagacttgggtttttcttggaaccaaaggaaaataagcatgttgagttcctcgttcaacagacatgacattgaagtaatagaatattttttaagtaaaatagttttcactttcaaagcctatgacataaggacatttgtgcttattaattgttaatttttttttatggtacattgtataaactgagtagcattgaactgcattttagaagtatgtcatcagaaacaaatcacattatggaaaggatatacaaatgccaagtgatatgactcttttggcatggtggtagcatggtccattcagctttcagaatctttcggaggctctagtttggtgcctagtactagttatttttgttagaacaatctctcaaaatttagataattttccagttgtatgtctgtcacttttaactctaaagcgtaagaatcatggtaaccctctcagaagtggtcctttcttgctcatttcagtttcgtattaatttcaaatcactgatgtattgtctttcaagctatcaattgttatatgtaccaatttaatttagtttgtagttatctgaagtcacaaaattggttcagcattgatgtcaaacaatggctttgcttcttaccaaacagacttagtatcctgctgcttgtttcaatcttgatgcagtaagtgatgcagtatctgggtctgtatttacttagaaactgtactgtcctttctctgtgcttaacttgctaaaaatatattcccttacctgtgaaattcctgagcggtgctctgccaacttttcaaggggagggatttggatggctgtgttactgcacactggatctggaattgttcagggttatgagtgacaaatttcttaaacaccagcagcactgagatgtgcactatgggcattcgtacagttgttgtccaaatgcaaacaactttttcatcttggagaagctgagatacagagttcaatagaactacttggaatattttgagaaggttgaatgtttcatctttggctttgttgtctctggagtggggaagtatggagggctttttttttttttttaaagagagtgtgtatgtactttttctctctataagggccagggtgttggtcaaattcaccatcgattaatttatatcttctgttgtgatttttttcaactatataacaagtgccaactaattgtccatgggacaatctacttttccactcaatttatcgttttgagtagggaaaggttcatttattttcattacctggcattaagttaaagaattcattattttgcatacatttgagtcattctgtgacctataaagtgtttttgtaactatctaattctaatggttgcaaagcaaagcacatgactgtaaaaccaagcaaggtgttttagtaactttttccctgaatacttggtagtttccattgatactattccaaaacaaattctgctgttttaggttgtatatttactttgcttttgttctaagaaaaagccaaggactaaatcaacttgtttttgtgtttcagtaatcagtttaaaatctaagatttttttttaaattagactatttaatgaagtgccatgtaattgtagcttgctagtgtttaatgtttaatagactggttctgtaggtgttttaaccatttaacactctctgccatccctggagaaagtggttctactcttactgaacacattctctctgacaaaatcaccagctgctttatttttctatttattacagttaaacagttgatgaggtctgaatcttgaccaaaactgctcagctgagatgtttttcacaatagacactgtacaaagtgtgcgtgcaaaaggacacggttggtagtattttttcattaatgtgaacattgactaaaaaaaagcagtcctgccttttaaatcttgtggcagctcagaagggaggtgcttaagaaccttaactactatgtcagataacaaaatatttttttccattttggagattggttactgctcacacatgatgtatagggctaaatatatgcttgtttccttgcacctgtgtacttcccctctctccctccctttccttcccctgtaggcaataaatggccattttgcaactgcat

SEQ ID NO: 404 - protein, 604 aa, Homo sapiens
KPGGAALVPLPDPRSVSSLPSAAFRAAASAVRQAARPGPPAPHPPRRAECRLIGMPKEKYDPPDPRRIYTIMSAEEVANGKKSHWAELEISGRVRSLSTSLWSLTHLTALHLNDNYLSRIPPDIAKLHNLVYLDLSSNKLRSLPAELGNMVSLRELLLNNNLLRVLPYELGRLFQLQTLGLKGNPLSQDILNLYQDPDGTRKLLNFMLDNLAVHPEQLPPRPWITLKERDQILPSASFTVMCYNVLCDKYATRQLYGYCPSWALNWEYRKKGIMEEIVNCDADIISLQEVETEQYFTLFLPALKERGYDGFFSPKSRAKIMSEQERKHVDGCAIFFKTEKFTLVQKHTVEFNQVAMANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRYNECLMNFSCNGKNGSSEGRITHGFQLKSAYENNLMPYTNYTFDFKGVIDYIFYSKTHMNVLGVLGPLDPQWLVENNITGCPHPHIPSDHFSLLTQLELHPPLLPLVNGVHLPNRR

SEQ ID NO: 405 - DNA, 3635 bp, Homo sapiens
agatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactctttgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtg

SEQ ID NO: 406 - protein, 981 aa, Homo sapiens
MAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAGAFSSDTSFF

SEQ ID NO: 407 - DNA, 1233 bp, Homo sapiens
actgaactttgagcttcaggcagcacaactcacatttgtgcaaagagctacatgccacatgctgttctccagcctgctgtgtgtatttgtggccttcagctactctggatcaagtgtggcccagaaggttactcaagcccagtcatcagtatccatgccagtgaggaaagcagtcaccctgaactgcctgtatgaaacaagttggtggtcatattatattttttggtacaagcaacttcccagcaaagagatgattttccttattcgccagggttctgatgaacagaatgcaaaaagtggtcgctattctgtcaacttcaagaaagcagcgaaatccgtcgccttaaccatttcagccttacagctagaagattcagcaaagtacttttgtgctcttggggaatccttcctgccctttcgggggaacttccattacaccgataaactcatctttggaaaaggaacccgtgtgactgtggaaccaagaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttgtaaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggaaaaaaaaaaaaaaaaaaaaaaaaaaaaa

SEQ ID NO: 408 - protein, 296 aa, Homo sapiens
MLFSSLLCVFVAFSYSGSSVAQKVTQAQSSVSMPVRKAVTLNCLYETSWWSYYIFWYKQLPSKEMIFLIRQGSDEQNAKSGRYSVNFKKAAKSVALTISALQLEDSAKYFCALGESFLPFRGNFHYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 409 - DNA, 1543 bp, Homo sapiens
ggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttatgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatg

SEQ ID NO: 410 - protein, 140 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 411 - DNA, 575 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcggc

SEQ ID NO: 412 - protein, 142 aa, Homo sapiens
MVLSPADKTNVKAAWGKVGAHAGEYGAEALERMFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 413 - DNA, 2010 bp, Homo sapiens
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcgggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggcc

SEQ ID NO: 414 - protein, 668 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGVVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 415 - DNA, 1011 bp, Homo sapiens
actcgcgcggatgctgcagggggcacttctgaataagatcaatgttggaaattttgtttcttcctctcagttccttcattttttttcacatcgatcctatctaccagcccaaaggtggagtgtatttcaggggagcatattgggccatagtactggagaatgtttgctgacccacaatttagggtctcacttaaaatcctagttctgccatttcctagctgtgatgtacctaggtaaattattccatccagttgcatctctttttatcttcctctgttaaataatagtatactccacagagagctcctgtgagattaaatgagctatgcacgtgatgtgattctgttgacctaaaatggagaccagtgtttgtctaatggagtgtaatggttacagacacaggctctagtgctaggctatgtgttcaaatcttagctcagttattttttagctgtctggccctttcataagttattttgccatactgagccttggttccccatctgagaagttgaaatttaaaaaaatccctcttactgtgtcatcataaggactaactaattgaaggtgccctggagtgcaatgcctgcatgtggttggagcacaccataaatggcagctgcagagctagacatatcttggggagtttgaataagtggggttaatatgtagactagttttctctgttctcactttgggggaaaaaccaactagcgtttccattattctaatctacttctcttatggactagaatagttaaaattaacaaaatgccttgttaggagtaaaatgggagcttggattctctttattatttgttttctggactggggtttcctgttggagttctgggctggtttcaaagtcccagatgctgggcagaataagaagaggtcttccctcagggttggcatcatttacttcattgaagtgaaatagcgtgtatcagagcaagtggaaccgacacccaaaatatgacttgaagaatgtaatttaaaatgtagcataga

SEQ ID NO: 416 - protein, 66 aa, Homo sapiens [sequence omitted]

SEQ ID NO: 417 - DNA, 2340 bp, Homo sapiens
gtctgaacctctgccagtcctggagactggtgccctgagctccaaccagcgggcctcatcctacaccctcaccaccgcaacttctcacccgagcaagaagcagctcccagagagaaagaacgttcccacctgcctagccatgggagaggacgctgcacaggccgaaaagttccagcaccctgggtctgacatgcggcaggaaaagccctcgagccccagcccgatgccttcctccacaccaagccccagcctgaacctagggaacacagaggaggccatccgggacaactcacaggtgaacgcagtcacggtgctcacgctcctggacaagctggtgaacatgctagacgctgtgcaggagaaccagcacaagatggagcagcgacagatcagtttggagggctccgtgaagggcatccagaatgacctcaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaataaaaagatccagcctgaagaaagtggatagcctcaagaaagcattttctcgccagaacatcgagaaaaagatgaacaagctggggacaaagatcgtatctgtagagaggagagagaagattaagaaatctctcacgtcaaatcaccagaaaatatcctcaggaaaaagctcccccttcaaggtttctcccctcactttcgggcggaagaaagtccgagagggagaaagccatgcagaaaatgagaccaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggccctggaacaggcacagaaggtacgctatgagggtagctacgcgctaacatccgaggaggcggagcgctccgatggggaccccgtgcagcccgccgtgctccaggtgcaccagacctcctgagcttagagccaccgtgccatcctgtgctgtgctcaagcgggcagccagggctgaagaacaaactcttgcacatctccagcacgactcacccactcctgcgttcctgtccaggcagtaatcattgaccatatagtcatagtaagacacacgagaccaggctttaccatgaaagcgacctgtcacggactccacttttaatttgctcttaggttctatctctgtagaatgtctccaagattgaagaagaaactgagcagttgaaaaatgctaatctctttgacttagtcagaaaaaaacagaggataattaagatactagtcatgaaaagtgattcattcttttttgtcattccataagcttgctgaatagtgtaccggtaatatattgtatttccaccgtactctgtgaatctaattattattctttaagtgttgatatataatatacataaatatgtaagctaaacatataactatatgttttaagaagaaaacatctacgaaaggtaaaaagagatgatcagttggttgtttacttgctagaaaccattgttttattgcaaacgaaggaaaaatgaagagattataaaagtcagctaatgaagtaagatacgtagtaaagtcaggactattcaaaaagtaagaaagaaaatttggaaaatgagagaaacaggaaacaaagaatgccgaaaagaatgaaaacagagaaaaaatgtatgtgcttgaaagtaaaatacttacaatagtagcttaactatttcactctttaaataaaaatactaaagaagttcgtatatcctggaataacatgtcatcttcaaaatatttttattttctaatatttttaataataaacattttatagtgttaaagctgtatttttcttaataaataaaggacattacaaataaaaaaaaaaaaaaa

SEQ ID NO: 418 - protein, 425 aa, Homo sapiens
MGEDAAQAEKFQHPGSDMRQEKPSSPSPMPSSTPSPSLNLGNTEEAIRDNSQVNAVTVLTLLDKLVNMLDAVQENQHKMEQRQISLEGSVKGIQNDLTKLSKYQASTSNTVSKLLEKSRKVSAHTRAVKERMDRQCAQVKRLENNHAQLLRRNHFKVLIFQEENEIPASVFVKQPVSGAVEGKEELPDENKSLEETLHTVDLSSDDDLPHDEEALEDSAEEKVEESRAEKIKRSSLKKVDSLKKAFSRQNIEKKMNKLGTKIVSVERREKIKKSLTSNHQKISSGKSSPFKVSPLTFGRKKVREGESHAENETKSEDLPSSEQMPNDQEEESFAEGHSEASLASALVEGEIAEEAAEKATSRGSNSGMDSNIDLTIVEDEEEESVALEQAQKVRYEGSYALTSEEAERSDGDPVQPAVLQVHQTS

SEQ ID NO: 419 - DNA, 4895 bp, Homo sapiens
gtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggtgaaaatgagaaacataaaaaatctttcctggaacgtagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcagattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttaaaaaaaaaaaaaaaaaaaattatttgaaggggtgggtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctt

SEQ ID NO: 420 - protein, 1429 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLERSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILDSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEADSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 421 - DNA, 1399 bp, Homo sapiens
tgtttatttgcctgtgtctcctgttagactgtgaattccttgatggtagggatggtgtttgccttgtttagtgttgagtccctaatgtctagtcctgtacctgctccacgtagtaggatcttagtaaatatttgttctgtaaatgaatgaaactgtggagctgaaattcaggtctgttcaattctagccttccactatcccaggtgaacaatgcaagaccaagtgagataggttctgtgagtgggaggccaggagtttgctgtgaaattccacggaaagaacagacatactatatggggggttgaaggagggagcttgtgagcttgatcttgaaagatgagcagaattttaagaataagcaaaagggaaccacataactgacaaagcaggtgtgagtgagcatgacttacttggagagtggttaggtcagggttgttgggggagtggtggcagataagggaaataagagagggcatgataatgggaagatgaagtctaatttgggaccagattataaaaggcctttattttatgcttagtatcttgggttttattttgtaggcaatggggattctataactttttaagaaaaatctttttattataaaacacagatattgaaaaccacataaaataaatgtatagcttaatgaactcttataggcttaactcttgtgcaaccccgcccaagttgagaagtagttctttccagccatcccagaagtccatccaggtgttttgtcctaattacaacttccttccacaaaagcaaacactatcctgacttttatagtgtttcttcatagtttatctaccacatgtgcagcccctagataccctagtttgctcattaaaaaaaaaaaaaattgatatgtctttggtatctcttaaattactcaaaagaaacttccgaaaacgtagctgttgaaaaaccagactgttaacctgtggagattctcccagttgggctttggctgattccatatgctgtttatgtgttggactgttgtgtaaagagatgctgcttctcatctgcgatgtggttacccagtagtgtagttcatgtagggaaggcaggataaaatttggattctgtttgtcagataatgatttgtttcctgctacctccaaagatgagcagttaggtgtttttttttttaaagaatcattacgggctgatgtttttaaccatagtgggtgtgttccatctctgtgtaatggttatgcctgttgaagctcaaattatcccatcttgggacaataagaacctcttcaagtgggttcctgagacctttttggacataatcccatcgtcttctgttatagcctcgggtcgataagatgtcccaagttcatctggtgcatttctgtgcccagacctttaatcagaacattctcc

SEQ ID NO: 422 - protein, 18 aa, Homo sapiens
MSQVHLVHFCAQTFNQNI

SEQ ID NO: 423 - DNA, 2139 bp, Homo sapiens
gtgagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagccctgctccagaagttagcttcaccccaatcccagctacctcaaccaatgccgaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggccacgagcttgttctttgttctttgtcacagggactgaaaacctctcctcatgttctgctttcgattcgttaagagagcaacattttacccacacacagataaagttttcccttgaggaaacaacagctttaaaag

SEQ ID NO: 424 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 425 - DNA, 1613 bp, Homo sapiens
gccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtactttgaaaataaaaaaaaaaaaaaaaaaaaaaaaaaaaaaaaaaaaaaaaaaa

SEQ ID NO: 426 - protein, 416 aa, Homo sapiens
MHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 427 - DNA, 693 bp, Homo sapiens
  Unsure 4: Unknown base
aganaattaatgattggaaagggcaaaagcaacatgtttttgggaggaaggatctgatagtttcttttacaaagtacatttacagatgctttaataatgagaaaaattaatggtaatcagaatgttttccaaaacagtacactgcagattgatcatcagtcactgatatgtaaagagtgttgccattaatattattctaaaaagctcattaaattggtcccacgaaataatatggctctagactatccagctcattatcattatccacctaagagtacgtaagaagtattttatatcatgtcttctttggccttttcactgagggcctgtgccattctcgatgcaaataatcttttctgaatatgggagaattactaacaaatttatacctgctcaccaggacgctatacatacttgcacatgtaattttgcttatagcttcagaagattcgtgggcccttccttcgccaaccatttcatgaacccatgagccccagattaagaactctttctcttggttgttgttaaaatataactacgtagcaggaagaggaccattgtgatccactaccaatagaacatttatagttgaaaatgcaatttgagttgtttgttcaccagtgatgctatgttatgcatttgtttacatctcataacatgtggtaaatatttatgcaagatggctagcaggac

SEQ ID NO: 428 - protein, 35 aa, Homo sapiens
  Unsure 1: Unknown amino acid
XINDWKGQKQHVFGRKDLIVSFTKYIYRCFNNEKN

SEQ ID NO: 429 - DNA, 8213 bp, Homo sapiens
cccccagcagaagggcgcgacggctgcaacatcagcggttaaattgtacagcctttcataggccggttcaatgcatccgtactaagattgttaaggctgagggtccctagcctggggaaaaacgaaaggaggcagagggtagggagacgggaaggaagacaaggagggtgtagaaaacggggagaggagggggcgggacagcatggggaaggcctcaggtttactggagagatcgtggcgttcccatagaaacgtatccctccgcccatgacccgcgtgttagtctcttcagttccttccgcgtcgtttcttggctgtttccgcccagctcctttgtgccgcgcagaacaacgagatgacgcatgcgcaaagcgcagcggccgcatatataaacgcgaacccgggctcttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggaggtaagaagctggagtccggtgagggacgttggtgtgggtgtagtgagcactgcgaggccgtagggttgtcgcggaggttgggagacggttattccgcgtgcgtaatggcggcttaggagcacgccagacgaagccggaggcagcggaggcggggtgctgaagggagacgggatggcgggtgtacatctctgccgagttccgtactcttgggcatttttgtggcccaatccagcctaaagcagggttgagatgacggttttcgcgttgcctttctcggagctgcccgccggcccccctccccccccgccctcggccggcggctgccattttgcgcacattgaggaccgtggtggcgcatttcctcagcgctttcccgccacttcagcggacagatctggccgcagctgtaagatcgtggttgtgtttgagatagaacgaaattggcagctgtgagctgcatgttctcgtcaaacaatcggttaaattgcggaatgggaatggggacgtaatctgcgactggcggctgggtttttttttagttatttccagcgcggtttatggctctggggcggggagctggagtcttgggcgagcctgtgcctgggacgtttgccgcggaggacgagagccggcgcagccctgctctcctggcccggcccctaccgaggccctcccgccgccgacgcgctgccgctgcgggcccgcgcgctcccggtgcgcccggggctgccgggactcatgggtggggccgggccaggtcccgccccacgcctcggtgtatcctaccacgcgtttctgcttgtgttcgggagggtcaccccgcattatttagaacgttaagaattttgtcaaaagtctagtttctcggggatttgcggacttcaccagttttacgactaagttttgtcttggatagagggcattaaatgtgctttacccaatcttgaggatggcccgttttaaggcaagtaagtaattgaaacttgggccagattttgcataacgtgcattcttctatttgcgtttttaaacagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaagtaagtaagatgttatgaatcttctgttcattaaaatatactgtggctagataatgaacttagtgctaaatttggattctgaagtctggaagagaccttaaatagctggtcatagtgttaaatgctaaaggcacacgaaggttaaagaagatagcggagatggagttagggcttggtaaagaccgccaaagtttgttgggggggaaggagtggttggaaagagtgagtggttggaaagagttctttttaaatctataagtcctgaatatatttttaactttagaattttgttaatttgcttttattagggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaataaaggaatggttggtattctagttaatcaagtaattcttttattagcaaggcagaaactagtgtttttctataaacttgaatgttaattgtacaggtgtattttacaatttgtgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttatgttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtgagatcttgtttaactgaagtctttctgtattattattaaattcactggtagtccaacacagaaaaagctcattattttttttggagacagggtcttgctctgtcacccgggctggagtacaggggcataaccacgactcactgctgccttgatgatctcttgggtttaagcagttctcctacctcagcctcccgagtagctgggactgtaggcactgccaccatacccagctaatttttatttttgtagaaatggtcttgcactgtttcccaggctggtctcaagctcctgggctcaaacgatcctcccgcagtgctgggattatgggcatgagccactgcaccgttccccagttgaagtcttaacaggccaaaaaaaaaaaaaactgtggagatggacttaaagttctttattttaggtcaaggtcagcatctcctcgacgatcaagatctatctctcttcgtagatcaagatcagcttcactcagaagatctaggtctggttctataaaaggatcgaggtatttccagtatgtaacactttttttccttacttgtgtttggattgttcacatcttatcagtagagtgtcttaaggacataattcaaatggattgcttcagggaatatttgagatgtaaaagtttggaatttatgtgtaacttgtaacataaatattaccctagtttcacagatgaagaaaagggctactagagattttaaggcttgttaggccgtgtggtagacaagggtcccaagcaatacagctctactcaacactctgggtaggcatgttgctataaacttttctggcttcagattggatgatactagctctgaaagatggtaattgattttcccgacaaaaaggcctattagcaccaggaaaagagatcagaagcaagtagaaacatttctcatttttggaatgatggggttgatttgagacactggaaagttgactagggcagtagtgtgtacacagaaatgaatgtggattttttttttagaccgtttcagacctgaaaaaactaaagaaccagagctttactatttgtagaaggccttaaaaggagatagaatggaaaaaattgtaaaataagtattgcaacatgtaattaacaatattgttatctgtaccaacgataaaaccgtggtacggaatgctactgggagttaaattgctgtttaatagcacaaaacctttaaatgcaggaattctgaatcttgtggtctatttgagaaagctatgaaccatctctttagataaatttaaaagatagatatgtcagtctgatttggtttgtctgacagattgatggctctcaaacataacttgatccgggaagaagcctgacaaatggggggcggctttcttttcgtctggccttatcacctgaattagtctcagttcaggggtctggttattttcatcctgccttagcctcctgagtagctgggactgccattgtgtaccacagtgcccagctgagggatctgtgccttaagtgaggttagttttgcttccttcataccagtctcatcaaatgaaaaccatgtatttcccttggatattacacagtgtttgagaatgttatacctgtacagaaactaaccaattgagtgatagaaacaagtaattgaaatgggggttccttatgtctggtaacactttgtttgacagtgtgttagacagaataaggcaagtgttgcatcttgtttagttttagcttctttatgcctgaccaacctaatacagtgttgagtagttaaggaaattcctttggactgattgatataattgtgttttttcactttttttattaagatccccgtcgaggtcaagatcaagatccaggtctatttcacgaccaagaagcaggtagggtaaaaatttgattatccttttctagttatatggcaccaatatccaaagagttcaaagtgtttttaattgttgaaattttaagtgttaactctaaacttaggttttagtgggaacacagtaccttatttgtgtatgtcctatttattactggctgactttccctgaacaagggaatgtaaaactatagtgagaaagaagcttatgacttgggggattatattaaagaggcccttgttagaactgataggtgcatggagaagcatcctgaaatcgatgtgcttaaagcagaatgtaaaagattaatcatgatgtagtaattgagtcattttttgaaaaacagttgttgaaagattggcttttgttagcaacaactggtaggatgtttttcagtttaagtgcagtctgacattttaagcttaggacatttgggggttttacggtattggtgactacaagaaagggattggttagtactctttctttaatagaatttctcatgttttgacagccgatcaaagtccagatctccatctccaaaaagaaggtaagctaaatgttttgttgccaaatcttgcctgtcaagtgtggcctctgcagaatttgtttgcttactgctttgcagtctttgagctctttggagaattggtgctatatagattaaaatactatgctaagtttctgaaatactttttttttttgattcagtaacattagtttatacttttgctggaaatacttagtcataaaatgttagggtgattattaagatgtgattggtcctgtgagtacttggtagaaattttggtaagatagatgccttttccccacatgtacaatagatacaaagtgtggagaaaagtcttggaaatagttacctgcctagtgcttctttatgaccagaaaacttcaaatagttgtcatatttatctagtgcttcttaatgaccagaagacttcaaatagttgtcatatttaactgcaggttgaccttgcaattttgacaaggaggatagcctaatttttttttttttctgggatggagttttcgctctgtccccaggcttggagtgcagtggctcaatcttggctcactgcagcctccgattcccgggttcaagcaattatcctgtctcagcctcttgagcagttgggattacaggcacccaccgccaagcctggctaattttttgtatttctagtagagacggagtttcaccatgttggcgaggttggtcttaaactcctgatcttaggtgatcacctgcctcggcctctcccaaagtgctggggttacaggcgtgagccaccgtgcctggccagggtagcctaatcttaagccagggacaaaagatgaatatatgtaagtttcatgtcatttttaggtctttgctataggaaattagtaccttaggccacctttgaagttattgaaagttagtacatgtacatgagagtttcaattgacactaattggatccaaacctaatgtttttctttttagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaaggataatataaattttgttgaatgtatgaacatcatatggtctgaaaatgtgggtttttatttggcacatttaaataacatgtttctaactagatttttgatttgtgttcaatattaacacttcttaatttgatatatttgagagtcagacattataattgttaatccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaaacctgctggttgcgcagatacctaggcttgtccattttatgcatttcagcaaagtcattggagactattgcaacttgggaatactggtctgcatcaagtttaattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataatcctgatacttaatttttggaagtgggagctc

SEQ ID NO: 430 - DNA, 5190 bp, Homo sapiens
tgggaatccaactgaagagcagccagaggagagctgaagagaggagggggaggccgatgacctgggctctgggcctctgaaggtctggcgtattctgacaggacacagtgagcatctgtagaggagaggcttgaaataaaggaggagcacgaatattccctggatttctggaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggagggcaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattgttggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttg

SEQ ID NO: 431 - protein, 1395 aa, Homo sapiens
MTGAEIESGAQVKPEKKPGEEVVGGAEIENDVPLVVRPKVRTQAQIMPGARPKNKSKVMPGASTKVETSAVGGARPKSKAKAIPVSRFKEEAQMWAQPRFGAERLSKTERNSQTNIIASPLVSTDSVLVAKTKYLSEDRELVNTDTESFPRRKAHYQAGFQPSFRSKEETNMGSWCCPRPTSKQEASPNSDFKWVDKSVSSLFWSGDEVTAKFHPGNRVKDSNRSMHMANQEANTMSRSQTNQELYIASSSGSEDESVKTPWFWARDKTNTWSGPREDPNSRSRFRSKKEVYVESSSGSEHEDHLESWFGAGKEGKFRSKMRAGKEANNRARHRAKREACIDFMPGSIDVIKKESCFWPEENANTFSRPMIKKEARARAMTKEEAKTKARARAKQEARSEEEALIGTWFWATDESSMADEASIESSLQVEDESIIGSWFWTEEEASMGTGASSKSRPRTDGERIGDSLFGAREKTSMKTGAEATSESILAADDEQVIIGSWFWAGEEVNQEAEEETIFGSWFWVIDAASVESGVGVSCESRTRSEEEEVIGPWFWSGEQVDIEAGIGEEARPGAEEETIFGSWFWAENQTYMDCRAETSCDTMQGAEEEEPIIGSWFWTRVEACVEGDVNSKSSLEDKEEAMIPCFGAKEEVSMKHGTGVRCRFMAGAEETNNKSCFWAEKEPCMYPAGGGSWKSRPEEEEDIVNSWFWSRKYTKPEAIIGSWLWATEESNIDGTGEKAKLLTEEETIINSWFWKEDEAISEATDREESRPEAEEGDIVGSWFWAGEEDRLEPAAETREEDRLAAEKEGIVGSWFGAREETIRREAGSCSKSSPKAEEEEVIIGSWFWEEEASPEAVAGVGFESKPGTEEEEITVGSWFWPEEEASIQAGSQAVEEMESETEEETIFGSWFWDGKEVSEEAGPCCVSKPEDDEEMIVESWFWSRDKAIKETGTVATCESKPENEEGAIVGSWFEAEDEVDNRTDNGSNCGSRTLADEDEAIVGSWFWAGDEAHFESNPSPVFRAICRSTCSVEQEPDPSRRPQSWEEVTVQFKPGPWGRVGFPSISPFRFPKEAASLFCEMFGGKPRNMVLSPEGEDQESLLQPDQPSPEFPFQYDPSYRSVQEIREHLRAKESTEPESSSCNCIQCELKIGSEEFEELLLLMEKIRDPFIHEISKIAMGMRSASQFTRDFIRDSGVVSLIETLLNYPSSRVRTSFLENMIRMAPPYPNLNIIQTYICKVCEETLAYSVDSPEQLSGIRMIRHLTTTTDYHTLVANYMSGFLSLLATGNAKTRFHVLKMLLNLSENLFMTKELLSAEAVSEFIGLFNREETNDNIQIVLAIFENIGNNIKKETVFSDDDFNIEPLISAFHKVEKFAKELQGKTDNQNDPEGDQEN

SEQ ID NO: 432 - DNA, 2927 bp, Homo sapiens
cgttttctgggtttttgttattttttagtggtaacacaagcctatagggcatttatagccacctattatactgtttccataagcctggctaccttttagggaagctattttttctctttcatttttactgtcacagcacatacacacacacctttttgttttaaaggattaagtactgtttgaagatcagtggtaacagaaaatttgggagggagaagaagaaattaagacatgacttgttagaaaattaagacttcagtttctagaattatcttttcatcaagatttggtagacattgagtttaaatggaaaggaaattatttaagcctgtgtatgttagatccacaatacaccattggtattgaaatataaaggttaaaaaaaaggcttatgacctctttaatgagataaatatgtatttgtcttgtaagcaggcagaaaatctacctctaattttaacactaatactttgaaacccacaatcaaatagagtgaattctccaagttacataagcaaggaaaacattatttgaaatatgccatgttttcgttgcctttggacacctcatcattcaactctaattttaccgagtcccgggatttgtactgtcccattgtacttgcaatctacaatttatataatagaaaaacaaccaaacccattcatacaaggatctgaagttataaggttaagggcagaaagtttcccataagtataaaacatttccaggtcatgaagagtagtttaggttgagtgacaaaagcctaggtgtggttgtttttcattcatttgcatctcacgaccaagacatttttgcttgcagggtcaatctgctgcttaaaatgtacaattaggtatataaaataagtacaatggtgaaaacacaaagccaggtaaagcagcatgccccactaaatttttcagtatacatagggacagacaagtgagttttggttgtatctaaatattttaatttcaggttccttctgtgccctgggccactatttcccaggggtgtgacagagatgcctgccagatccatatcaactagaagtctgatttctgttgctgcccttcctcagcaactatggcagtatacttttatcaccaagcaccactcccttgtccctgaatcacattttaatagagtacaatatcttctgtacaatatttctgaaacacttatgtctgaaatatatgctgtattgtatgttaacccatgacatatatgaactacaaggcttgcataatcagtgagctagtggataaatcaagacaggagcaaatgggagaaagatgaataaacaaatgaaaaaagatgaataaatgaataagagagatgaataaacaaatttacattacatgtgatagttatcatggtatggccttcatgacaagatggatgagaatatcactgataggatattagccttctttcatatctttatattgaaatatgggctttacttcaatttgaaggtctttcatgaacaataaaagagagtagaaggactgtctgagaaggcaggagacatataaaacagatgactgaaagactgactagctcctggaaagggaaacatttggaacatccagagtaagggcaaatgggcttctaccagcacaacaaagagcctccaggtggcaacatggaagcaggttatcagagaaaataaatgtgcaaattccttatttacaatgactcacttaaccccacaaacatgtttcactgctgccttccccagttgtcgcttatgtactgttgttacctttcagttacatgcctttgatcctaaaattctctacttttgttgccttatcagttctttgcaatctgcctgtggttatcagcacttaaagcacaattttgaaggggaaaaaaatgataatcaccttagtcccaaagaaataatttgtcaaactgccttattagtattaaaaacagacacactgaatgaagtagcatgatacgcatatatcctactcagtatcattggccttttatcaaatggggaaactatacttttgtattacatagttttagaaatcgaaagttagagactctttataagtaatgtcaaggaacagtaatttaaaaacaaagttctaacaaatatattgtttgcttaatcacaatgccctcaacttgtatttgaataactaaataggacatgtcttccttggagctgtgggcattagttcagaagcactacctgcatcttaattttcaaaacttaagttttattagcaaatcctcttctctgtaagacttagctatgaagtggtatattttttccaaatatttttctgaaaacatttgttgttgtaactgcacaataaaagtccagttgcaattaactagtgtgagctcttatttaactgaagcaaatgctttctgacagtgtgtactttgaattttttaacaatataaaagacaacattttctgcattgttaacaaatatagagaacaaaaatccatttatacaaataatttcttggatcattcaggtccaatttaggacctttaagagtataaatgtaaatgtatccgatatcatggcatctttattccagatctgttactgaattatttgaaagaaaaatgcttcacataaaacagattaagaactgagaaaacataaagcaataccttctgggctgccatttcctcatctatgagaagggtgcaggacatgatctttaatgtctttttcagttccgttggctttttattcttacaaacctgaagttcacttagtttctaaagagtatgggatgaaggagaaactataacaagttacaaaaaatttattttgtttataaacaaaaattacaaacaaaaaattataaattttgtttgttaatttataaacttacctttaaaattaaacaaaaattacaaacaaaaaacaaaatcataaatt

SEQ ID NO: 433 - protein, 32 aa, Homo sapiens
RFLGFCYFLVVTQAYRAFIATYYTVSISLATF

SEQ ID NO: 434 - DNA, 4371 bp, Homo sapiens
gggtggattaattttttttttttgacgttcttagaacagtgcctgacttaattctacttcatagggttgatgtaattttgagacttaaataagttgatactaaaataccacttagtgtcccgaacactgtttgacattttagtatcaaccaagtctcaaggttacttcaatcctgtgaactagagccaaggcacctccagtggcctttcagaagttccatttccactcccgcctcatctcctaattctatctccccgttctctttactcgagccctcctggccttgcccttccttaggcctgatacgcacctatctgaagacctttgcactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcctcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctgtccgagccacagagcgacttggaggagctgcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtgaagctgttggagctgcaggagatggtgttgcggcttgtggcagctatagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtgccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattctccaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatggctatacgatcgcagagttgtatttcctcacaaacttctttacgaagagtgaaatatgtttttgtacctctcagtttcagtcagggacatattttgtgcaatatttctgtgattgtgcctatgcgtgatgagtgaatgcatttcaatcatacattgcctaaatcataacttgatgatgcttgggaaagaatcaacagttaaaacttcatgaagttc

SEQ ID NO: 435 - protein, 459 aa, Homo sapiens
MKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREQEKRLQQLSEPQSDLEELHENKSALQLEQQVKELQEKLGQVTETLTSAEKEPEAAVPASGTGGESSGLMDLLEEKVDLREHVEKLELGFIQYRRERCHQKVHRLLTEPGDSAKDASPGGGHHQAGPGRGGEEGEAVGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 436 - DNA, 449 bp, Homo sapiens
ctcattttgcccatgtgggagacttagcctatttgcccgcctccactgggaggggcttacagaaagagccatcagccagagggctcctacagagtcatggggcttctgctccccagggcgccaagcgcctgctgcctcatgggtagacaaggttagagaacacattccagctaatctgctggggtgtggataggagactttccgtggaaccttacacagccgagcctttgtgtttcactatttcaggatgcaaactgagcaaggaactgataccagggccagcacgacagcaaaacctcctaatgttttaaaatttaaacggctcacacagaaatgagagttccaattgattttatttaaaataaaactatcaggatgctctctgatcatttagaaaatttggaaaatgcaaaaaataataggaagggaaaagttttgcatagtcttac

SEQ ID NO: 437 - protein, 63 aa, Homo sapiens [sequence omitted]

SEQ ID NO: 438 - DNA, 5584 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgatgggcctcagcagcagttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctagaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaaccc

SEQ ID NO: 439 - protein, 396 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVMGLSSSFGDEANQPLAGRGLFSSEVKGAGEWTTQSSLLQTSLWR

SEQ ID NO: 440 - DNA, 624 bp, Homo sapiens
acactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaacttc

SEQ ID NO: 441 - protein, 147 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 442 - DNA, 9120 bp, Homo sapiens
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcattcattcacatagctcccagttttaacatttcgccacctactgaagacatcatttgggaccaagctgatgagcccttgaagcacagcagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtgccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaaaatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacgtggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtggtgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctattcaccgggaaccctccctgtccccttcccgaatcacacacataccctaccctcacctgatgataattttctcttcttgctgcaaaactggttggcttgcaacccagagagagcagcttcccttggctctgggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaagggcttttctttttaaacagttccacttttaaaacctgcctctgggtttttgttttttcttgtttgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactcgtgggtgacagtgagaatataaactcaatgtgaatcacgtgatacttcggcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtcacaaataggtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaattttaccttttgggggaaaaaagcattgctatgaactaatggaattggaacttcatttactcattgtaaatacactattgtgcaaaaaaagttttcactcaattgaattgctagtgttaactgaattttgtctagacaccatttctgttgatgaaataaagacatatcattatgcattgtaaactg

SEQ ID NO: 443 - protein, 841 aa, Homo sapiens
MSVDEKPDSPMYVYESTVHCTNILLGLNDQRKKDILCDVTLIVERKEFRAHRAVLAACSEYFWQALVGQTKNDLVVSLPEEVTARGFGPLLQFAYTAKLLLSRENIREVIRCAEFLRMHNLEDSCFSFLQTQLLNSEDGLFVCRKDAACQRPHEDCENSAGEEEDEEEETMDSETAKMACPRDQMLPEPISFEAAAIPVAEKEEALLPEPDVPTDTKESSEKDALTQYPRYKKYQLACTKNVYNASSHSTSGFASTFREDNSSNSLKPGLARGQIKSEPPSEENEEESITLCLSGDEPDAKDRAGDVEMDRKQPSPAPTPTAPAGAACLERSRSVASPSCLRSLFSITKSVELSGLPSTSQQHFARSPACPFDKGITQGDLKTDYTPFTGNYGQPHVGQKEVSNFTMGSPLRGPGLEALCKQEGELDRRSVIFSSSACDQVSTSVHSYSGVSSLDKDLSEPVPKGLWVGAGQSLPSSQAYSHGGLMADHLPGRMRPNTSCPVPIKVCPRSPPLETRTRTSSSCSSYSYAEDGSGGSPCSLPLCEFSSSPCSQGARFLATEHQEPGLMGDGMYNQVRPQIKCEQSYGTNSSDESGSFSEADSESCPVQDRGQEVKLPFPVDQITDLPRNDFQMMIKMHKLTSEQLEFIHDVRRRSKNRIAAQRCRKRKLDCIQNLECEIRKLVCEKEKLLSERNQLKACMGELLDNFSCLSQEVCRDIQSPEQIQALHRYCPVLRPMDLPTASSINPAPLGAEQNIAASQCAVGENVPCCLEPGAAPPGPPWAPSNTSENCTSGRRLEGTDPGTFSERGPPLEPRSQTVTVDFCQEMTDKCTTDEQPRKDYT

SEQ ID NO: 444 - DNA, 630 bp, Homo sapiens
gttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctactggtacaaataaacctgaggcagga

SEQ ID NO: 445 - protein, 159 aa, Homo sapiens [sequence omitted]

SEQ ID NO: 446 - DNA, 3084 bp, Homo sapiens
aagatctaaaaacggacatctccaccgtgggtggctcctttttctttttctttttttcccacccttcaggaagtggacgtttcgttatcttctgatccttgcaccttcttttggggaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgacgccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagctatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaaccccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaagcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 447 - protein, 399 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 448 - DNA, 1643 bp, Homo sapiens
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggagatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcctatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 449 - protein, 240 aa, Homo sapiens [sequence omitted]

SEQ ID NO: 450 - DNA, 678 bp, Homo sapiens
acattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtggttttttaaaacatgtttacattggtatcatttatttgtattgccttctatttcagcagttagtttgtcatttctttttccattaatcatcattctggtgttaatgaatgcattaaatatttaaagtaaaaaaaaaaaaaaaaaa

SEQ ID NO: 451 - protein, 46 aa, Homo sapiens
MCMCVGVCLITLLDRFLWFGTAGAKFIQKSTFLSKLPMTLVSFHSI

SEQ ID NO: 452 - DNA, 1409 bp, Homo sapiens
gaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaaaaaaaaaaaaa

SEQ ID NO: 453 - protein, 331 aa, Homo sapiens
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILGALTVFYPSIALWLLAFISADRYMAIVQPKYAKELKNTCKAVLACVGVWIMTLTTTTPLLLLYKDPDKDSTPATCLKISDIIYLKAVNVLNLTRLTFFFLIPLFIMIGCYLVIIHNLLHGRTSKLKPKVKEKSIRIIITLLVQVLVCFMPFHICFAFLMLGTGENSYNPWGAFTTFLMNLSTCLDVILYYIVSKQFQARVISVMLYRNYLRSMRRKSFRSGSLRSLSNINSEML

SEQ ID NO: 454 - DNA, 901 bp, Homo sapiens
  Unsure 610-649: Unknown base
ccttcctttcgttccttccagagaatttgtgttctctgtacctgagatcaaatgtgtgtctaagcaattctggcccctggctcccaccaccctaccctctccacaaaataatagacattaggggaggtaagggaacagaagaggtctctttgcagatattatatttttaaaaaatggttctatgtaataagcagcagctaaggagacagaaagacagtagatgaagagagtgccaatatcttccatggggaaaaatgaatgaactgaaagagaatattatttttctagaatacagaaagctgtcctctcacagatcagctggaattccaaggtggattatggacttcttctaactcccattgatagtgcttcttaccaggtgaagggaagggctactttttcctaaaggagaaaaaagctttcagacaaagctcgtaccaacccctgaactgcaaatttgctcaagtgaccgtgcatacttatattcctaatttaaatgattatttatgtcaaacgctcattgtgaaacttgaaaatgttgtattacattacatcaaataaagtttacttgtagcagacagaaagagagaaagagaaagaaaggaaagannnnnnnnnnnnnnnnnnnnnnnnnnnnnnnnnnnnnnnnggaaataaagaaattaaagggctgggcttacaggagcctggagggttgggagatctacaggggttttaccaccggggaacttgaggctgagggtccagtcactgtgggcagtgacaggtgtggatgtggtgtcttctgggaaggggcctgctgacaacaagcttcctccagccctggctggacatagagggaaacaaagtcaccgatcctcagtccaccagaaggcagttttgaccttgaagaagagggcta

SEQ ID NO: 455 - protein, 55 aa, Homo sapiens [sequence omitted]

SEQ ID NO: 456 - DNA, 2047 bp, Homo sapiens
gagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtcaaaaaaaaaaaaaaaaaaaa

SEQ ID NO: 457 - protein, 365 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 458 - DNA, 3639 bp, Homo sapiens
gcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtgaaaaaaaaaaaaaaaaaaa

SEQ ID NO: 459 - protein, 1123 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 460 - DNA, 1961 bp, Homo sapiens
ttatgccggggagggctgagctatcgctagggaacccacggtgactgaatcaaagggaagaaagacccaagacctggatctcccttttacatggaccctaaagcaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaacgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaaaaaaa

SEQ ID NO: 461 - protein, 306 aa, Homo sapiens
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 462 - DNA, 2816 bp, Homo sapiens
aaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtatattcaggtgtcttgttaacttatttatataaataacctctttttctaaggtggtatcttgagtttacgtgttagggataatctgacttttctgttgctctaaaccagggagctgccttttattactgaagaagtcgtctttttaaattttcaaagatttaaaatgttgagctttaaatttgatctcaagtttcttccctgaagacagctgttctaattaagaactttctaatcctgtttttgctccactcgcacctggggttttcttaccacttttctccaaatctaattctgttaatgtacagtttttttaattcaacagacaaacactgaagatgggtgttgactaaaaaatattgcagactggtcagaagtgaatctaaaagacaaactcgctaccttaggaccg

SEQ ID NO: 463 - protein, 98 aa, Homo sapiens
KKKVPTAHHYRSREDNYAENRVSGGQQECSWSFGPLRDGGSAEDTGEVLYTEDLWLGAGVVHGSADFFSLFSTNVCVIFVLQTVPFGFSAYFIIFVQF

SEQ ID NO: 464 - DNA, 4853 bp, Homo sapiens
ttcgccgtttgaattgctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgtctgccgagtcgcccacccctcagatccagcagcggttcgacgagctgtgcagccgcctcaacatggacgaggcggcgcggcccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcattccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccactcagtgattactgtcaaggctgcttacaatccaaacttgggtttttggctctggcaaagcttttagaaatactgcaagaaatgatgtgtacccaacgtgagcataggaggcttctgttgacgtctccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaagtcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctccccaaatatttataaaacttctcaagatactgctacgtgtaattttatatgaagataagtgtatttttcaataaagcatttataaattaaaaaaaaaaaaaaaaaa

SEQ ID NO: 465 - protein, 1139 aa, Homo sapiens
MPSGGDQSPPPPPPPPAAAASDEEEEDDGEAEDAAPSAESPTPQIQQRFDELCSRLNMDEAARPEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 466 - DNA, 4201 bp, Homo sapiens
gtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaagtctttctgtcttgttttgaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttccgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagag

SEQ ID NO: 467 - protein, 628 aa, Homo sapiens
MAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKSFCLVLKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 468 - DNA, 1890 bp, Homo sapiens
gacccacgcgtccggggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactaaaaaaaaaaaaa

SEQ ID NO: 469 - protein, 195 aa, Homo sapiens
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPEGPYGVFAGRDASRGLATFCLDKEALKDEYDDLSDLTAAQQETLSDWESQFTFKYHHVGKLLKEGEEPTVYSDEEEPKDESARKND

SEQ ID NO: 470 - DNA, 2021 bp, Homo sapiens
agccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcctcctcctggccgctctgggtgtgacagctggtgcccatcgcttgtggagccacaggtcctaccgggccaagctgcctctgaggatatttctggctgtcgccaactccatggctttccagaatgacatcttcgagcggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaatacacagcacatccagaaagaaggaagagctctcaatcaagaggcagcgtgtgagatgcttcgtgagtggcatcaagggcatatattgaaagtcacccttcccggattacacattttagctttgttacatactcattgtaaccactccgaaaagtgctgcttgatgctgcgtgctctttctgtgtccctggaggtattctgaaggtcagaagagagatatacaacagcgaggcttggtgataacgtatagaataacagacggggactccacacccaggccttttttaacggtgtgaagcatagacagagctgcagtctgtgctaacattaggttatttattgattcaatcagttgacacaaggaggcagctacggggaggtaaaatatggtcctaaaatcaaaaagatttcagttttgtcattctgtctctgagattctatttccacatctagagcagggtaataatgatacctaccttacaaaattattgggagaatacattagttaatatatgtgaaagtatggaggagatgtgcaataaatatttgtgttattaactacacatacagcactctataggagatattccatttataaaaactttaggttctaaaaacctgtacacgttgattatttttgtaagtcaaaagtgattaagaggagtttaagctatcatttccagatgtatttctataaataaaaacataagtatattcagttgatttggggtggagagttccatagatgtctgttaggtccgcttggtccagagctgagttcaagtcctgaatatccttgttaattttctgtcttgttgatctgtctaatattgacagtggggtattaaagtctcccactattattatatgggagtctaagtctccttgtaggtctctaagaacttgctttatgaatctgggtgctcctgtattaggtgcatacatatttaggatagttagctcttcttgctgcattgatcccattaccattatataatgcccttctttgtcttttttgatctttgttggtttaaagtctgttttattagagactaggattgcaacccctgctatttttttttttttttttgcttgataaatattcctgtatccctttattttgagcctatatgtgtctttgcacgtgaggtgggtctcctgaatacagcacaccgatgggttttgactctaaaaaaaaaaaaaaaaaaaaaaaaaaa

SEQ ID NO: 471 - protein, 256 aa, Homo sapiens
MPGPATDAGKIPFCDAKEEIRAGLESSEGGGGPERPGARGQRQNIVWRNVVLMSLLHLGAVYSLVLIPKAKPLTLLWAYFCLLLAALGVTAGAHRLWSHRSYRAKLPLRIFLAVANSMAFQNDIFERSRDHRAHHKYSETDADPHNARRGFFFSHIGWLFVRKHRDVIEKGRKLDVTDLLADPVVRIQRNTQHIQKEGRALNQEAACEMLREWHQGHILKVTLPGLHILALLHTHCNHSEKCCLMLRALSVSLEVF

SEQ ID NO: 472 - DNA, 640 bp, Homo sapiens
attctgagccgagcccggtgccaagcgcagctagctcagcaggcggcagcggcggcctgagcttcagggcagccagctcctcccggtctcgccttcctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacctcatcgactacatcttggacctgcagatcgccctggactcgcatcccactattgtcagcctgcatcaccagagacccgggcagaaccagcgctccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttt

SEQ ID NO: 473 - protein, 134 aa, Homo sapiens
MKAFSPVRSVRKNSLSDHSLGISRSKTPVDDPMSLLYNMNDCYSKLKELVPSIPQNKKVSKMEILQHLIDYILDLQIALDSHPTIVSLHHQRPGQNQRSRTPLTTLNTDISILSLQASEFPSELMSNDSKALCG

SEQ ID NO: 474 - DNA, 1556 bp, Homo sapiens
ggctaggtgcgctgcgagcgcgcggagccacgagggcggacggacgtaatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaa

SEQ ID NO: 475 - protein, 351 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 476 - DNA, 1403 bp, Homo sapiens
caaatccgtgctcctagatttgcaggttctgatactgtggttcgagctacactcgccgcctgggcagacactcgtccaaaccactggagtgtgctggtgatcgcagccagcccttcgcctctccatgaacccgtgagcctggggcaggtgccaggcgatggcgcggcctgtgagcgacaggaccccggcccctctgctgctgggcggcccggccgggacaccccctggcgggggagcgctgcttgggttgcggagccttctgcaggggaccagcaagcccaaagagccggccagctgtctcctgaaggaaaaggagcgcaaggcggccctgcctgcagccacaacccctgggccaggcctggagactgcgggcccggcggatgccccggctggggcagtggtgggcggagggtccccgcgggggcgcccggggccggtgcccgccccgggtctgttggcgccactgctgtgggagcgcacgctgccgttcggcgatgtggagtacgtagacctggacgccttcctgctggagcacgggctcccgcccagcccgccgccccccggtggcccgtcgccggagccgtcgcccgcgcggacgcccgcaccctccccagggccgggttcgtgcggctcggcttccccccgctcctctcctgggcacgcccccgcccgggctgccctcgggaccgccacgggccaccgcgcaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcaggcgtctcctccgcttgctgagacttacgccctgttcccttcctgccctgtgcccacgggccggccagctgggtgccccagggacgtgataatgcagataaatacatttatatttttaagaaaaagcgagcctcccccctcttgcgggggcggggagggttctctgtgtgtccccggcacgtcagggaccctatcctcccaccgcctccgttaacacgatcctgaataaatcttgagaacccc

SEQ ID NO: 477 - protein, 325 aa, Homo sapiens
MARPVSDRTPAPLLLGGPAGTPPGGGALLGLRSLLQGTSKPKEPASCLLKEKERKAALPAATTPGPGLETAGPADAPAGAVVGGGSPRGRPGPVPAPGLLAPLLWERTLPFGDVEYVDLDAFLLEHGLPPSPPPPGGPSPEPSPARTPAPSPGPGSCGSASPRSSPGHAPARAALGTATGHRAGLTSRDTPSPVDPDTVEVLMTFEPDPADLALSSIPGHETFDPRRHRFSEEELKPQPIMKKARKIQVPEEQKDEKYWSRRYKNNEAAKRSRDARRLKENQISVRAAFLEKENALLRQEVVAVRQELSHYRAVLSRYQAQHGAL

SEQ ID NO: 478 - DNA, 978 bp, Homo sapiens
caaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaaaaaaaaaaaaaaaaaaaaaaaaaaaaaaaaaaaaa

SEQ ID NO: 479 - protein, 293 aa, Homo sapiens [sequence omitted]

SEQ ID NO: 480 - DNA, 2564 bp, Homo sapiens
gatttcagttgaaagatgtgtttttgtgagtagagcaccgcagaagaactgaagactgttgtgtgctccccgcagaaggggctaccatgatcctttcctcctataacaccatccagtcggttttctgttgctgctgttgctgttcagtgcagaagcgacaaatgagaacacagataagcctgagcacagatgaagagcttccagaaaaatacacccagcatcgcaggccgtggctcagccaattgtcaaataagaagcaatccaacacgggccgtgtgcagccgtcaaaacgaaagccactgcctcccctcccaccctctgaggttgctgaagagaagatccaagtcaaggcactttatgattttctgcccagagaaccctgtaatttagccttaaggagagcagaagaatacctgatactggagaaatacaatcctcactggtggaaggcaagagaccgtttggggaatgaaggcttaatcccaagcaactatgtgactgaaaacaaaataactaatttagaaatatatgagtggtaccatagaaacattaccagaaatcaggcagaacatctattgagacaagagtctaaagaaggtgcatttattgtcagagattcaagacatttaggatcctacacaatttccgtatttatgggagctagaagaagtacggaggctgccataaaacattatcagataaaaaagaatgactcaggacagtggtatgtggctgaaagacacgcctttcaatcaatccctgagttaatctggtatcaccagcacaatgcagccggtctcatgactcgtctccgatatccagttgggctgatgggcagttgtttaccagccacagctgggtttagctacgaaaagtgggagatagatccatctgagttggcttttataaaggagattggaagcggtcagtttggagtggtccatttaggtgaatggcggtcacatatccaggtagctatcaaggccatcaatgaaggctccatgtctgaagaggatttcattgaagaggccaaagtgatgatgaaattatctcattcaaagctagtgcaactttatggagtctgtatacagcggaagcccctttacattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggcggcaaggaattgtttggtcagttcaacatgcatagtaaaaatttcagactttggaatgacaaggtacgttttggatgatgagtatgtcagttcttttggagccaagttcccaatcaagtggtcccctcctgaagtttttcttttcaataagtacagcagtaaatctgatgtctggtcatttggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgcggagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaagaagtgaaaaagacttcgcagcagtcttcattgtggtgctcttcatgatcatagccccaggaacccttgaggttcttcttcacaaggctgagagtgcttccttcttgaagacgagtgtcattcatcacttcagtgatccatgcatagaatatgaaaataaattcttccaactcatgggataaaggggactcccttgaagaatttcatgtttttgggctgtatagctctttacagaaaatgcacctttataaatcacatgaatgttagtattctggaaatgtcttttgttaatataatcttcccatgttatttaacaaattgtttttgcacatatctgattatattgaaagcagtttttttgcattcgagttttaaacactgttataaaatgtagccaaagctcacctttgaacagatcccggtgacattctatttccaggaaaatccggaacctgattttagttctgtgattttacactttttacatgtgagattggacagtttcagaggccttattttgtcatactaagtgtctcctgtaattttcaggaagatgatttgttctttccagaagaggagacaaaagcaagatagccaaatgtgacatcaagctccattgtttcggaaatccaggattttgaattc

SEQ ID NO: 481 - protein, 527 aa, Homo sapiens
MILSSYNTIQSVFCCCCCCSVQKRQMRTQISLSTDEELPEKYTQHRRPWLSQLSNKKQSNTGRVQPSKRKPLPPLPPSEVAEEKIQVKALYDFLPREPCNLALRRAEEYLILEKYNPHWWKARDRLGNEGLIPSNYVTENKITNLEIYEWYHRNITRNQAEHLLRQESKEGAFIVRDSRHLGSYTISVFMGARRSTEAAIKHYQIKKNDSGQWYVAERHAFQSIPELIWYHQHNAAGLMTRLRYPVGLMGSCLPATAGFSYEKWEIDPSELAFIKEIGSGQFGVVHLGEWRSHIQVAIKAINEGSMSEEDFIEEAKVMMKLSHSKLVQLYGVCIQRKPLYIVTEFMENGCLLNYLRENKGKLRKEMLLSVCQDICEGMEYLERNGYIHRDLAARNCLVSSTCIVKISDFGMTRYVLDDEYVSSFGAKFPIKWSPPEVFLFNKYSSKSDVWSFGVLMWEVFTEGKMPFENKSNLQVVEAISEGFRLYRPHLAPMSIYEVMYSCWHEKPEGRPTFAELLRAVTEIAETW

SEQ ID NO: 482 - DNA, 9078 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgag

SEQ ID NO: 483 - protein, 2000 aa, Homo sapiens
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRD

SEQ ID NO: 484 - DNA, 1847 bp, Homo sapiens
gtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcagacagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaacaaaa

SEQ ID NO: 485 - protein, 423 aa, Homo sapiens
MVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRPERNTKLWIGLFLMVCLLCVGIFSWCIWKRKGRCSVPAFCSSQAEAPADTPGYEKLDTPLRQPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 486 - DNA, 626 bp, Homo sapiens
acatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgc

SEQ ID NO: 487 - protein, 147 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 488 - DNA, 2261 bp, Homo sapiens
  Unsure 1653-1925: Unknown base
actgcagcaggagcatgtccctttaagcacagatcactgcaactattgtttgtggtttaagaatgcctttaagcagttttccacccccaggcaggcccaggtgttctttgccctcattcccagtaaacccacaaccttccagcatgggtgttagggccattatgaacatgttacagtgctgcagagattttatttatggccagtttatggccagattttggggggcctgctcccaacactctacatatgctccatcttgcagaggcttcattcttggttctctagctaaaaacagtagaaattttgcacacctgggttagaaaaaaaaaatagccattaaacccacccctgttacaggtcactattggtattttgattttgccttcaatccatctgttattgtttacttttaagagtccttgatagttgctttttatgtccagagttttaatttcagtcagaaagagaaataggccttggtgagcatgctttgtcttggctggtgccagaagtctgtactcaaatattttaaaaataatttttagttgaataacaagttagacctgtgtttagctttctcattgttttcctaaaaatagaagaaaaggttttaaatactttaaccacgaaatactttaaagcaggtttaaaataaactccttcattttgcctgttctattactctgttctcacactgctaataaagacatacccaagactggtaatttataaagtaaagaggtttaattgactcacagttccacatggctgggggaggcctcccaatcatgggcagaaggtgaatgaggagcagagttacaacttacatggtggcaggcaagagagagagcatgtgtgcaggggaattccccctttataaaaccgtcccaatctcatgagacttatgcagtctcatgggagcagcatgagaaagacctcacctccgtgattcagttacctcccactgtgtccctgccacaacatgtgggaattgtgggagctaaaaatcaagatgagatttgggtaggaacacagtcaaaccacatctcctatatacattcacactagcattttagttttagaactagttctatgttactatctgaattaatttttccacaattttgtaaggaaaaataatgcgttctttgaatttcatgtgtaaatgatatttttagttttgtgtcattttgtcaaataaattctgaaaatctttgtattgacagtgtgttatctctgcataaccatatatgtataagagtgctcaataaaaagaataaagaggaaacagcactggatctatacctatacaaaacaagctaccagcagagcccactgggaatggtcatgatataatcaggaatgttatattcacacgttgtagatctgcatatgagaggagggtttgcagatagcagattctagaaaagttgtctaatcagacagtaaatgaaggtgttgaagcactgaacaaaaataagctgctttaattactcataagagggaagtacaagtcattattccatctgccaatttacagactgtaagataccctttaaaagtagcagtaagtaaactcttcataaaagttagactgtatgacaaatccactgcctttcttcttttgcagcagggcctttctttttaatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctagtgactatttttgaaaaaaaaagcacattaccctcccttgttaatcacttatgtacaaaaatgcatgttttgctgttgatctgttttaactctttctacataaataacacatttgtacatgtatatgtgcagatatatttataatgttaaaattgtgtttaagtgatgtttactaaacaggataaaattttgtttggaaaattgcgatgtgaaattttatctagttaatctatagtcctttcccttatggtgtccagctctatgcaggctctgcctcactccagattatgtaaatatcaattcatattcaaatgaatttgaaatttagct

SEQ ID NO: 489 - protein, 158 aa, Homo sapiens
  Unsure 19-109: Unknown amino acid
MTNPLPFFFCSRAFLFNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLVTIFEKKSTLPSLVNHLCTKMHVLLLICFNSFYINNTFVHVYVQIYL

SEQ ID NO: 490 - DNA, 4199 bp, Homo sapiens
gaattccggccagagtcacacacggtcctaagagctgggcaccaggaagcgaaggctgatctgaagaagacacttgaatcatgggtgacgttaaaaattttctgtatgcctggtgtggcaaaaggaagatgaccccgacctatgaaattagagcagtggggaacaaaaacaggcagaaattcatgtgtgaggttcaggtggaaggttataattacactggcatggggaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacacaccatggaggacctcttctccacatcttggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaatccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttacaccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggatacagcgttcgatttgagtctgtacttcctcgtcctcatgccagtataatgttttgtactgtaggtgtgctcctgagaaaattagaagcaggcattcgaggaatcagtcatgtaattgtagatgaaatacatgaaagagatattaatactagcttccttctggtagtactgcgtgatgttgttcaggcttatcctgaagttcgcattgtttttatgtctgctactattgataccagcatgttttgtgaatatttcttcaattgcccatcattgaagttatggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaatgatgttgtttatgtcattgactcctgcaagcagaaagtgaaactcttcactgctcacaacaatatgaccaactattctaccgtatgggcatcaaaaacaaaccttgagcaacggaaagggcgagctggccggagtacggctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcgtcaatgaaggaaagcaactgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaattacccatctcccttctttgtatttggtgaaaagattcgaactcgagccatctctgctaaaggcatgactttagtaccccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctgagccctcagctgctggtatcaaccttatgattggcagtacacggtatggagatggtccacgtcctcccaagatggcccgatacgacaatggaagcggatatagaaggggaggttctagttacagtggtggaggctatggcggtggatatagcagtggaggctatggtagcggaggctatggtggcagcgcaactccttcgggcaggatatgtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacaccg

SEQ ID NO: 491 - protein, 1279 aa, Homo sapiens
MGDVKNFLYAWCGKRKMTPTYEIRAVGNKNRQKFMCEVQVEGYNYTGMGNSTNKKDAQSNAARDFVNYLVRINEIKSEEVPAFGVASPPPLTDTPDTTANAEGDLPTHHGGPLLHILALKAENNSEVGASGYGVPGPTWDRGANLKDYYSRKEEQEVQATLESEEVDLNAGLHGNWTLENAKARLIQYFQKEKIQGEYKYTQVGPDHNRSFIAEMTIYIKQLGRRIFAREHGSNKKLAAQSCALSLVRQLYHLGVVEAYTGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESVLPRPHASIMFCTVGVLLRKLEAGIRGISHVIVDEIHERDINTSFLLVVLRDVVQAYPEVRIVFMSATIDTSMFCEYFFNCPSLKLWRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYSTVWASKTNLEQRKGRAGRSTAGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFVNEGKQLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMNYPSPFFVFGEKIRTRAISAKGMTLVPPLQLLLFASKKVQSDGQIVLVDDWIKLQISHEAAACITGLRAAMEALVVEVTKQPAIISQLDPVNERMLNMIRQISEPSAAGINLMIGSTRYGDGPRPPKMARYDNGSGYRRGGSSYSGGGYGGGYSSGGYGSGGYGGSATPSGRICAGVGGGYRGVSRGGFRGNSGGDYRGPSGGYRGSGGFQRGGGRGAYGTGYLDIEEEVAAIKLGYVSSVCRQ

SEQ ID NO: 492 - DNA, 7603 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 493 - protein, 823 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 494 - DNA, 2572 bp, Homo sapiens
gtagatgtctagttattcctcatgtaaaacacaacatttcaaccctgagtactataaactttattatgcttctaggttactttttctctttaagcaattattcctacattcctaagtgttcaccagtggaacagataagagatagaagtagttagaaattgagataattgggttgacctgtcattgttgccaggataattactggaagattaagcctatctgttagacattttgaccatgtttataattgttgttagtattctgtcagaatgtatctgttttctagttattaaaagaagcaacagaatcgaggcacaaatatgaagaaatgaaacaagaagaagcacaactgaaagagcagcttttcctttatatggataagtttgaagaattccagactaccatggcaaaaaccaatgaactttttacagccttcaagcaggaaacggaaaagctgacaaagaaaattaaaaaactggaaaaagaaatggtaatatggtataccaaatgggaaaataataatacaacacttctgcaaatggctgaagagaaaactattcgtgataaaaattataaggtctttcaaataaaattggagcggttagagaagctgtacaaggctcttcaaatagaaaggaatgaactcagtgagaaactgggaattctgaaagggcaggtctctgtgaaagtagcagatgtagatttagcagtgcctgtgacgcattcctgtgctgacctggattcttccaatatgctgaacacttcctctaaaagagccccaggagtccatctggaggctgaccccaaaggaatgaatgaagtaaaatgctactcaaaagccctctccacaggatctcctctaggcattgattaagattaagtgtgatcattgtactgatggatatattttgtgtacatgtttctcttttagttgtaactattgattttgtaatgaaaatttcctctcctttttctaccatatctctgtttttttagaactactcaactgtgtggtaacagaaagcttcttaccaatttccccaactatgttgcacatcagcctcattttccccctttattggaatgcatgttttcattgccttctcctttcaaagtgtacgtttgtgtgttcatcaccttaaattatcttaatttgagacttttttataatggtttcgtaatgtgaaatcaaatactaatttaaactctggagcccataatatctacataaaagaaaatataaactgactaatattgtcaagtcatttaaatgataagtaaaacttcaatggattaagaaacaagcatggcatatttgattcagatcagttttttgacaatatttgtatgactttccaaattgatgtgactgtaaactttgaattcctcaaaattgacagaatatatatatatatatatatatatatatatatatatatatatatgtatgtacacacacacagagagatcatttaaatgtaaatgatgttaagaaaaaccaaaacagtagcatatgcaggcaagtcattggaccaataggcttaatatttatgaaactgacaattgttctgctttagtttcaggttacaattatgtttaaagaaaaaaaaatcagtatctagatctctgcacttggcatggaaaattttgaactatttattccttaattttcttttatttcagtttctcatagagctaaatggttttacatatattctcttgtcagatttgtggtctaatagaggtagaaaatggaaattttcccagtacttagaaatatggtacttaggaagaagtctaggatgtgaattacatatacacttcccctagtgactatgataatcaagggggcagatagcagaggaaaataagttaacatgaaatttgacaaattttattactttgccaaaattagcaaaacaaaaatactcaccttcccctgctcaccccccaactttttataaatattcaattcagctacaaaacaaaatactggacccacttctttcagaagagatgaagataccttatatgccctaaagttaataccagcagtcatattttatcagatgtaaatctggatgtaagctcttaatgttatactaaggcagtttcttaggctgtgacacttctttgtggtacttgttttgtgtgaaaggtaaattttggggagaaaacaatgtgaaaaacagaacttgttctgttgtttttggcatactgtttatgttagatacactgtgttacaatacaatattacgaagatctgcattgtattttggaatttggtttcctttcagaattattgctctggctagcattggaaacaacaacaacaacaaaacccaaaggaaccctttgcagaagattcccttgtaaatggccctgtggcatgcccagtatctgcaatgttctagaatagaagttggcaaacctctctgtttgccaagcctgcagagttgaacatgtccataaatgtatacaatctgaccctgttttttggccctgtttctggacactgtagctgaccaagaaaatgtttaaatgttgcgatcaattaaatttttttgttgta

SEQ ID NO: 495 - protein, 181 aa, Homo sapiens
MKQEEAQLKEQLFLYMDKFEEFQTTMAKTNELFTAFKQETEKLTKKIKKLEKEMVIWYTKWENNNTTLLQMAEEKTIRDKNYKVFQIKLERLEKLYKALQIERNELSEKLGILKGQVSVKVADVDLAVPVTHSCADLDSSNMLNTSSKRAPGVHLEADPKGMNEVKCYSKALSTGSPLGID

SEQ ID NO: 496 - DNA, 4343 bp, Homo sapiens
agatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgccgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcgtatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaaaaaaaaaaaaaaaaaa

SEQ ID NO: 497 - protein, 543 aa, Homo sapiens
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 498 - DNA, 1723 bp, Homo sapiens
gggggagtgcgaatttcttggcctgtcggcaggtgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctgccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacagtgtggttacacagtgtgaataaagtgctgcggagcaagaggaggccgttgattcacttcacgctttcagcgaatgacaaaatcatctttgtgaaggcctcgcaggaagacgcaacacatgggacctataactgcccagcggacagtggcaggacaggaaaaacccgtcaatgtactagggtactgctgcgtcattacagggcacaggccatggatggaaaacgctctctgctctgctttttttctactgttttaatttatactggcatgctattgccttcctattttgcataataaatgcttcagtgaaaatgcagctttactctaa

SEQ ID NO: 499 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 500 - DNA, 1653 bp, Homo sapiens
agcgatttcatcttcaggcctggactacaccactcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaaataacaactagggacaatacagaacccattccatttatctttctacagggctgacattgtggcacattcttagagttaccacaccccatgagggaagctctaaatagccaacacccatctgttttttgtaaaaacagcatagctt

SEQ ID NO: 501 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 502 - DNA, 2340 bp, Homo sapiens
aggcgctgcggagacgcgtagaggagcgcgccccccggccgmtgccgmccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaaaaaaaaaaaaaaaaaaaaaaggctctttaattaggcg

SEQ ID NO: 503 - DNA, 3087 bp, Homo sapiens
tttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccttgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaaaaaaaaaaaaaaaaaaaa

SEQ ID NO: 504 - protein, 795 aa, Homo sapiens
MAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 505 - DNA, 3087 bp, Homo sapiens; identical to SEQ ID NO: 503

SEQ ID NO: 506 - protein, 795 aa, Homo sapiens; identical to SEQ ID NO: 504

SEQ ID NO: 507 - DNA, 3105 bp, Homo sapiens
gcacgagggactggggcggccacgcactccgccagaaggtcgccaggagcctccgcccttcaccttcctcggaaatccgccaggccacgcaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggatcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacaaccaggatggagataaaggaactcaaagaatttgggctgcccttttcttgggcctgggggtgttgttctccttggtcagcattcccttggtcatctatgactgggcctgctcatcgagtaatggtgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttgggtaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaaaa

SEQ ID NO: 508 - protein, 527 aa, Homo sapiens
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTDRSSLFELAKKTKFNLCRHTVVTCILLVVINLLVIFIPSMKDIFGVVGVTSANMLIFILPSSLYLKITTRMEIKELKEFGLPFSWAWGCCSPWSAFPWSSMTGPAHRVMVKATETRREKETSLLSAQSSPHTSAISHHFFCKFTEANRNVQDT

SEQ ID NO: 509 - DNA, 4457 bp, Homo sapiens
gacctgagcgactgcggccgcgtcttcccggtctcctttcccggccgcacagggttttataggatcacattgacaaaagtaccatggagttttatgagtcagcatattttattgttcttattcctccaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcacaaataaaaggatgcttattattc

SEQ ID NO: 510 - protein, 1300 aa, Homo sapiens
MEFYESAYFIVLIPPIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 511 - DNA, 1672 bp, Homo sapiens
gacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtatagggcaaagcctgcctgcggcgaccctggctgctaggccattctctaggaacagctgcgactcataaagaccaagaagcataaataaactttcaaaaatttatttggctctttcgttaaaaactgtgcaatcaaaaaaaatctatgtcgggtgcggagaaagaggtaatgaaatggca

SEQ ID NO: 512 - protein, 286 aa, Homo sapiens
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPLNVGIRLPGRQTNQRAEIHAACKAIEQAKTQNINKLVLYTDSMFTINGITNWVQGWKKNGWKTSAGKEVINKEDFVALERLTQGMDIQWMHVPGHSGFIGNEEADRLAREGAKQSED

SEQ ID NO: 513 - DNA, 2040 bp, Homo sapiens
ccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtcaaaaaa

SEQ ID NO: 514 - protein, 321 aa, Homo sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 515 - DNA, 1474 bp, Homo sapiens
aaagacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtccctttttatcatccttaaaacaatgatgcaaaagggctttagagcacaatggatct

SEQ ID NO: 516 - protein, 297 aa, Homo sapiens; identical to SEQ ID NO: 501

SEQ ID NO: 517 - DNA, 1735 bp, Homo sapiens
cactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgc

SEQ ID NO: 518 - protein, 475 aa, Homo sapiens
MVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 519 - DNA, 3439 bp, Homo sapiens
gcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcaaccaggacaccatcaaccgcatcatcaaggtcatgaaacacgaagcctacggagagtgctacaaggtgagctgcctggaaatccctgggccctctgggcccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgagggcccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacatatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgatcgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcactgccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaaaaaaaaaaa

SEQ ID NO: 520 - protein, 1019 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEINQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDEHIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 521 - DNA, 1999 bp, Homo sapiens
acgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgctgttcgtggtgccgcgggccgcgctcctgtcgcagcacacctgctccatcggcggcctgctggagcgagagcgagttgcgctgcagggccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggtaccactggaggaagaagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataactaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaaaaa

SEQ ID NO: 522 - protein, 449 aa, Homo sapiens
MATQAKRPRVAGPVDGGDLDPVACFLSWCRRVGLELSPKVAVSRQGTVAGYGMVARESVQAGELLFVVPRAALLSQHTCSIGGLLERERVALQGQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQVPLEEEEDEKEPNSPVMVPAADILNHLANHNANLEYSANCLRMVATQPIPKGHEIFNTYGQMANWQLIHMYGFVEPYPDNTDDTADIQMVTVREAALQGTKTEAERHLVYERWDFLCKLEMVGEEGAFVIGREEVLTEEELTTTLKVLCMPAEEFRELKDQDGGGDDKREEGSLTITNIPKLKASWRQLLQNSVLLTLQTYATDLKTDQGLLSNKEVYAKLSWREQQALQVRYGQKMILHQLLELTS

SEQ ID NO: 523 - DNA, 2917 bp, Homo sapiens
catcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcagggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagtcaaaaaaaaaaaaaaaaagg

SEQ ID NO: 524 - DNA, 436 bp, Homo sapiens
aactccttcaatttgtaaatctctggttaaatagaaaggtagcagatcagccctccttgatctctgccaacttaatatttgaacagagatttaaaggaaaaaatattacagaagtgggaatcctcaaaatactttctaaaactagctttgggctgggattataggcataagctactgcacccatctcagaatttgtctatgtttacaatattatcaatgggtagacagctaattgcacagaatataaatgaggagaggtagatttttattaatgtgtacattttccttaattcctgatttactcaggcccaggcttctttgtttctggtcttggatctatgggcctgtgtaaatctttgtcacttagctaaaaggatttcttgaaaatccttgtagttgtttattgagcatttactgtgtactaggcactattgta

SEQ ID NO: 525 - protein, 53 aa, Homo sapiens [sequence omitted]

SEQ ID NO: 526 - DNA, 1676 bp, Homo sapiens
  Unsure 138: Unknown base
gggcaggtgcagttgtaatcgaaattcacggaacagtagttctggtgtgtcacctttatattcaccagtgtctttctgtggaattcctgtaggagtgctacagaataaactcccagacctttccttagataacatgantgggcaaagtgcaatgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttctttgctacctcaacaccaaacaatatgggattagtgagaaatgaacttcaactggttgatcttccaacaggtttgtttttaaagatccaaataggtttgtcatattgaataaacatgttgccatttataaaacatgtttgaaagtacttctttcaccttggaattttttttaatatttcatgcttatatatttattcttttattctctaataattgccctagaaaggcctcatcattgtttacatggaaatgttgttggcacaaatacatggtaaaatggaggaccattagcctgaacagacagattcattaaaaaataggataccggttctacttttaagtgcattgttatatgtaaccaactttaaaagatcgatttaaaaataactctgtcaatggactttattagagtctgtgctggaaattttggcttttataggaaacacttagaaaatttataggttaaggattgtttttaaatgctcaaatttaaaacttgtaatagtctctggctgaatgaatagagaaacttaatttgggattttgaagattctacagtaggaaacgtcccaataaggtaactttttcagaattgaaagcctaaacccagtgaatttcaaaataaagaatttgaaaatataataaggaaagagtttcaaattattttctggtgtatgcagtagtttcaaagaggtttttttaaaaataaaattgtgatgagtttctttaaaatggtatagcaacacgaatcatatgtagatgatcttaaccaatgagagcatgtgtatgtatgtgtaaaatgaattaaatcaaataaatggttgtaaatcaagtaagttgtaaataaatgaagtacatggttgcttttttatgttctccatatgtattttcaagctctcaaagatccagttgttcttacttctcagggtatgttgctgaacttccaggaatcattcccgtctttagtccagtgttgctgctctagtctcattggaagtgacctgtccactgactctcatccccaagttcctaatttgccagcagaatggtactggccctgtgtctagtgatcccagggataaaatgctgttgtctagtatcattgacttaaaaaaaagaaaaaaaatccctgttttatttgttttggtcagctcaagttcaggactgttagataacttaaaatctgctttgcacagatgtatttttaaggaacaaacatctacagtaacagttacagat

SEQ ID NO: 527 - protein, 70 aa, Homo sapiens
  Unsure 46: Unknown amino acid
GRCSCNRNSRNSSSGVSPLYSPVSFCGIPVGVLQNKLPDLSLDNMXGQSAMLGKNIPEVQFCGKCTSSSC

SEQ ID NO: 528 - DNA, 575 bp, Homo sapiens; identical to SEQ ID NO: 411

SEQ ID NO: 529 - protein, 142 aa, Homo sapiens; identical to SEQ ID NO: 412

SEQ ID NO: 530 - DNA, 1499 bp, Homo sapiens
tttaaactgctagaaaggaagagccgaatatttggctggagtgatttttagacatttctctaccttagggcaccagagaggttcacttgcccagggttccatagctggttggtgccagagtccgaacgagaaaccaggtcttctcagctcctgtcacccacagttttgcagacactgaatttatgaggtggattccattcaagcatgcacataactagcagacacttctcctaatcctcctcaattcccctttgcattgctcagataccacaatcctttgcaggttaaatcccttcaccttgtgaactcattaggcagggcaatgtatatgaatccctgagtccttaagaacgtccttaggctgtgttagaaatgcagttgccataggagtaaccggcccctgctgtcatttggatgttctctcttccccaaaatccagcaccaccttggttaagcacccaccatgtgcctgcccacctggctccttaggcaatgttacaattaaccaggttggttttgatgagggtctagggcaaaatttgaaccaccacaacagccaatgtgcacatccatgcagagggttcagagatggcctcggccaaggatgccaggcttcagctctggaaggagccctgggaggtgggagatctttgtataaaaattggaacccaaactataattcccattagggatatatatgctcacatcactcctgattcaaagctcagaagtggcctctcaggagaaataaaggtctctctctctctctctctctatctcacacacacacacacacacacacacacacagagagagagagagagagagagagagagagagagagagaggccagcattcaaaattcccatgcttagggaatccattgggacttctccccaggatgtactgaattcaaggaagctttctctaggtgtagcagaaactgctgctgtcatgtctctgctcaccaggacgtagcttctctctacagacctttatttctttccctggaggcttcagtccatgttgaagtgtaaactccactcagctccaggaggaatcgtgttttctttatcaccaggggcttcttctacgagttgcctttgatagggaggccaggaggaagataggcccaagctcaggggtgggatcggggagcaggaagcctgtgggctttagaatcgaggtattggtttctccctgtcaccgtcatccaccacctgtgtgaacttgagccatttatcgaacctcacggagccccaagtttctcatctgtaaacaaggggaatgagccctactttgtatggttgtcaagaggatttgagacaatatgtataaagcaatggacacgcagaggaagtcaataagtacaaggtaactctgaaaatgccaccaaagggaggctagggacaggaaagccatctccgccaacctcaagaacgtggccccgaagctgttccaggaactgggcatgtatgaagataaaaaaaaaaaaaaaa

SEQ ID NO: 531 - protein, 129 aa, Homo sapiens
MASAKDARLQLWKEPWEVGDLCIKIGTQTIIPIRDIYAHITPDSKLRSGLSGEIKVSLSLSLYLTHTHTHTHTQRERERERERERERPAFKIPMLRESIGTSPQDVLNSRKLSLGVAETAAVMSLLTRT

SEQ ID NO: 532 - DNA, 488 bp, Homo sapiens
cagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggc

SEQ ID NO: 533 - protein, 142 aa, Homo sapiens; identical to SEQ ID NO: 412

SEQ ID NO: 534 - DNA, 5611 bp, Homo sapiens
gcgcgaccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgcggagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccatatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacagaaatgaaagctactcatagcgggggcctaaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagaattagagcatgggagggtcatcactatgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttacatactgtaacattcaggaattcttggagaagatgggtttattcactgaactctagtgcggtttactcactgctgcaaatactgtatattcaggacttgaaagaaatggtgaatgcctatggaactagtggatccaaactgatccagtataagactactgaatctgctaccaaaacagttaatcagtgagtcgagtgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttggggggggctttttttctttttccggaaaatccttaaaccttaagatactaaggacgttgttttggttgtacttggaattcttagtcacaaaatatattttgtttacaaaaatttctgtaaaacaggttataacagtgtttaaagtctcagtttcttgcttggggaacttgtgtccctaatgtgttagattgctagattgctaaggagctgatacttgacagttttttagacctgtgttactaaaaaaaagatgaatgtcggaaaagggtgttgggagggtggtcaacaaagaaacaaagatgttatggtgtttagacttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaaaaaaaaaaaaaaaaaa

SEQ ID NO: 535 - protein, 1073 aa, Homo sapiens
MAAAGQLCLLYLSAGLLSRLGAAFNLDTREDNVIRKYGDPGSLFGFSLAMHWQLQPEDKRLLLVGAPRGEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPYLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 536 - DNA, 996 bp, Homo sapiens
gtgaccttgggcaagttgcttaacctttaaacattgattaccccatctgtacattgtgcataatagtaatatttactccacagtgaggaaccaatgagattgcgtgtataacatctgctggctcactgagtgacacaaaggaagtgctccacgagtgttgattactctctgagtactgctttttctgatctagcaatctggttctctggggttgggaaagtcagaataagatatttcagataccaccagagttaccattagcattttggtatgttttgtttctctccatctgtatttttaatcatagttgtaattatgattatatatatgtaaatatatatgtctgcgtatgtgtgttttgtgtatccgtatacacacacctatacaaatgatgttttcacattatgtcataagcatttctctgctactgtatgattttcatactcactatttgtagtcactacaaagtgttaggttggagaagttttgctgttggagcctgagggtaagaaaatgttagtctcttcaaaatagaatcagtgagtactagaataggtagtgattttgaaatgtcaggaagagattaattattattctttttaaagtatattctctttttgtaaccttagtcatttattcctgaatttggggagaacccaccagaagcctggcggtccactgtggatggggcagtaaacaggctggcacggtgtctccggaagcttacgttctgagtttagtgggtagaggtaaagaaagaagatttaaaaaaaaaaaaaaagcggtgctatgtagatattaatatagggtgatgagactttcctgttaaaaaccagctgctaattcctgagtagttcctgtgttctgaggactgtgcattacaccctttcattctcacagtcaccctgcatggtaagtaggccttacctacttatagcgcccttccagtggtgaaagggaggcttcttggagggtaagtaacttgcctgaggtcac

SEQ ID NO: 537 - protein, 9 aa, Homo sapiens
VTLGKLLNL

SEQ ID NO: 538 - DNA, 2572 bp, Homo sapiens; identical to SEQ ID NO: 494

SEQ ID NO: 539 - protein, 181 aa, Homo sapiens; identical to SEQ ID NO: 495

SEQ ID NO: 540 - DNA, 584 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatacaaataataaatctattctgctaagagatcac

SEQ ID NO: 541 - protein, 147 aa, Homo sapiens
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTGVASALSSRYH

SEQ ID NO: 542 - DNA, 2743 bp, Homo sapiens
ggggggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattccaaaaaaaaaaaaaaaaaaaaaaaaaaaaaa

SEQ ID NO: 543 - protein, 349 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 544 - DNA, 2010 bp, Homo sapiens; identical to SEQ ID NO: 413

SEQ ID NO: 545 - protein, 668 aa, Homo sapiens; identical to SEQ ID NO: 414

SEQ ID NO: 546 - DNA, 2582 bp, Homo sapiens
ttccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacccttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgt

SEQ ID NO: 547 - protein, 662 aa, Homo sapiens
PAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTLLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 548 - DNA, 1242 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaa

SEQ ID NO: 549 - protein, 231 aa, Homo sapiens
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 550 - DNA, 4853 bp, Homo sapiens
  Unsure 239-278: Unknown base
caaggatttgctagctgataaagaactgtgggctcgacttgaagaactagagagacaggaagaattgctgggtgaacttgatagtaagcctgatactgtgattgcaaatggagaagataccacatcttctgaagaggtatacttcttgtgataaggatgttgcaagttcagaaccattcagtggtcaagtgaatagtcagttgaactgttcagtgaatggttccagatcttaccacagnnnnnnnnnnnnnnnnnnnnnnnnnnnnnnnnnnnnnnnnattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggtgtgtgtgtgtatcttttaattctttatttcatatagtatctttgaccagttttagctatttaatctgaaaagtcataagattaaattaattctaggttttatactttcttggtactaattaataaaaaattaatagtcacaaacagtacaaatattgtgataatcaaatagtttattttttgataaacacattacttgtcttaacgttctatttcagcaaaatgggaaatttaaaatgtcttacttggcattatgtattacatttgtagctaggaaattatttcgcagtttattttaaataaattaccagtaggtcattttctgatagtgtaaggagcagattacattattctcttttaaataccttggctaagttaaagaaaaataatgcatgcatagcagataattacctaaagtctaatattttaccttgtaccagtgaaacttaactcttgggggattatggaattgttttataatctgatgaaagctgtagaccctgtccatagaaaaaatagtgcacactcaatacactttcacccaccacacttcttacagtttttggtggtggtgcaggggaggttaggaaatccccaaataaggatgtctgtgaaatataaggctattgatttcttcattcttgtgttttggtgcgtatttgaagttttcaatttaaaaagtatttaggaagattggggaacccatgcctggatcaaaccagtgtacacatttgtatatacaataagatacatgcatatatataaccttatctaaaaattccattgcttttactaaatggtattatactcagtgtattaaatggtaattggggatggagattggtagcatttagggacagtacatatgactagaatgttttcttcccctcttcttagtataatgatcttaggtgacctggaaagtatcttaccttatttgatagtcttccatactgttagaaaacaggtaatggatgttatcaggtaattgctgataaatgtttgaaaattagttttttgtaaggacttagtgtatcatggtacagctagagtgtggaacctattttttatttcacccttagtagctttgcattttgtatggaaatgtttaatagtagttgctatacattttttaacatcaaagaaatagttcatgattatggtaagtactttggaagatatccttttcagtatctttttaaatgctaaaatacctctttttcaaaggcattttaaatagaagaaggagaagaaggctctatgctcatcgtgataaagtggagtttttaggaaagtaagctttaagctgcttttaccagttgaactccaaaaataatgtaggagagagatggctttctttgtttttgtttcagtggcggggcaaggtagaagaaggtggctttttaaattatttaggtgttacgttgttttaactaattttgagcacttggtagacagaggagaacaaaatgtacattaaagttcacctgtcaaattttcatttgtagagggaaggatggaggttctaaataccagcaatcttaaaaaaaaaaaaaaatattaactccttgtgtcttacctatttttgtataaaacgacatgtacagatatttccagcaatttatgcacattctttaattctgttccagttgaacatatagttgaccagattaaatgcagcaaacatccaggtgaaattgagtcatttctttttttgtggaacttctgatttctgtcattgagttaattatattaaaattttgaaacctgtacttattcctactagtatcagcacttttatttttcaacttccactgatcttttaaaattgaggcaatatgcagtaaaatatttaaataattgcataaacaccaccaaagagatatcagttagaaatgtcagtactggtgaaactaagctattggctagcaggcagcaaggccatcataggatagctcattcatcaactgatgtacaaaagtcagagtttgacaccctaatagcatttttattttaatacattatttttcacagcatgggctggacatgaatggaatgtatgaaagtttgaagaccttttatttatccatttcttttttttcccagataaaatttacattttacattttgttttcttgcatgtatactgtaaaaattacttctgtttggtggtgaaattaaaacttaatggtgttggtttctctgaacaattagtattttggtgtagtagtgttgtctagccaaaaatctcgtgaatttacttttaatgaaaagaattgccaaatgagtgaatgggaagattttgtgggtgtcttatttgcattttattaccataacctgacttttgttttctaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcctatctaagtttgcctttatgatgcagtggcagcattttgaattacttttcaaagaatactgttcatatgcattgtttttgtgtttcaaactaaatacaggcagatttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctcaaaaatgttgtgaactttatgattcaaaattgagtacagatatgtccttgattcatatgtatgctacatgtatcacacaacagatctggaattctttcagttcctcagatacttctcccttagtttttgcagtttcactgggattatgttttgggaaacaaggaaaggtctagatgcttaaacattttaaataaaaattccttacagtttcatcttcccaacattttcattctttaaggctactttcctactaactgaaataacacatttacttttaccacaattcctcaaaataaatttattctaacattgaaaataacattacaagttaatcattagcttgatgcatgctaaaatgtagcttttaaaaagcattctgcattagtactaaaataagccatcaatgccagtccaccctctctattcatggctaaatatttaaaggttatttatagcttctttaatgaattcttcttaaacaaagtgaaattatgtcctagaaaagtagaagctattcgtaactagagcagtgcaactttaaagttttatgaatatgtattttaatgacaagggggcgagcttgcatccccactagttaatggataattcaaaccgaggactgattttgaaagatcacctaaaaatgtagatttgttctttagtaaatttagatcaactatgcatatattttgtaggtaaatctttcagtccatgccccaaccctcaccaaaaccaaagcagaaattacacacacaaagatgctcccgttaggaattgctattcacatgaggctttctgtgctagatttttttctcagaaacaaactttactgtaggactattgtggtgttcttaacagatttgtaatttcaagatgcgtgtcattaaataatttttcatgttcacagacaaa

SEQ ID NO: 551 - protein, 226 aa, Homo sapiens
  Unsure 44-57: Unknown amino acid
MEKIPHLLKRYTSCDKDVASSEPFSGQVNSQLNCSVNGSRSYHXXXXXXXXXXXXXXIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEVCVCIF

SEQ ID NO: 552 - DNA, 2418 bp, Homo sapiens
gtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggatggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaagatatggacatttctggaattaagagccccctctacattgagcacaagacagtgacgaatccacattcttcagccagaaagtcacctctgagagccaaatgtctgactatagaaaggagagtcaaagaatgataacgacatctcaggaaaattgtgaaaataatcagcagccggatgtggataaccctttcaaatttctcctggggcctccaaccacccccactggtgttctcctgctgacagtgatttcaattttttctgggctggagctccctgatggaggggcaggccaccatctttgctgtttttgcaacttagccacttcagccttcagtctttggagtgtccaaggagaccagggggtgatgtggaccctcagcatagcacagctgctctataaagatgaggccagactgcttttttgagcactttcccaatgccattcctcctcactgggcaaaacctccaaactggggtctccagccacctcctacaggtgtgtttgggccagcaacaagttcattcatacctccctagggcaaagcttccaaagggagcggtaggctgccatctttgctgtttcacaggcttcactgatgataactccaggtactggaaaatctgaggctactagagactggagcgggccctgggcatactgcagcagccctatggaaaagtggccagactgttacctgggttcccattcctatatcttctcactaggcaagtcttgcaggcctgggcctctacctaaccccccctaccagaactgttgagccagtagcaactcagccactccctggagagagcctccaggggcaactgaaagcctctctgccactgcttctgcagtggaactgtccttgctaccctcagactgatgaaggagctaacacccttatctacaccttcaacaagctttaattgaccaaagcccatctctcatgggttctacacactccccactgctcatgacagggaacccctggattggcccccacagcacgaattctccatcctgattgctgattgcagtaaacagttgctgtattctccaggggtggtggaactctgaggagacaaacaaaagacccttggctacaaccactactaatgtcccttcctcttctgcctcaaagttaggaaagaaatataaacactgagattgccccagagctgcagtgggcagcctaggagtgccaagccatgacctacagccagcactcaagggggagagaagcacattttcagatcattgagagggaacatggctgcaactgtaaggaaacataggggagccacatgaccaagcaagagtctaccaactgaccagtaagcccaagtgccacctactggatcacatcccaaagcttcagcatcaaaaataccctactaatatactcccctctgaaaccagaaatgagaagtcagcttcaaataaagaccctgcacaaagcctcagcctggtgaaaacatccgaaaataagtctacggactgtactcaatctacactgcaattaaaggaaaacccataggtggaaatgagaagaaaccaatgcaagaactccagtaactcaaatggcctctgtgtcatatgtccttctaacaaccacaccagttctccaacaagagttcttaacctggatgaactgtctggaattacataaatataattcagaatatggataggaaaaaaaatcatcaagactcaggagaatggcaaaacccaatccaaggaaaataagaataacagtaaagtgttacaggagctgaaggataaagtagctggtataataaaaaagaacctaaccgatctgaaagcgccgaagaacacaatacaagaattccacaatgcaatcacaagtattaacagcagaaaaaaaaacctgaggaacgaatctcagaacttgaagattggttctctaaaataagatggacaaaaaaaaaaaaaaaaaa

SEQ ID NO: 553 - protein, 137 aa, Homo sapiens [sequence omitted]

SEQ ID NO: 554 - DNA, 521 bp, Homo sapiens
cacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcac

SEQ ID NO: 555 - protein, 142 aa, Homo sapiens; identical to SEQ ID NO: 412

SEQ ID NO: 556 - DNA, 732 bp, Homo sapiens
tggaagaataattaaagatctttttttttttttttttaaagcaaaaagctagacaattgtttcatcattttttattaaatcacctgtcttttctccacagatacaaatgctatgtctaaattttatcacagtcttgggtctgttgttgggctgtcttttgctccattgatgtgtcttttggcaactgtggctttttgtttcactgtacttctttatttgtcataatattgaggcatattctttgtaattcttgtttttagaattttcatagctattcattctcatgcttctcagtgttttctgaagtcattcatcattttctagaaaatttatgattggcattttgattggaatcccttggaattcatcagttagagttgactactgtaggctattaaaacgtcttcctataagaatgtagatatcagactggtgaaaatttaaggagctgaagtaattttaaattttaattgtaagattttcgtggaggtgatttttcaaaaaggtttagttactgatgttggttcctgtgttatttctggtagatgaatcaattatattaggtaaaagtattatcattggcatgattaaaaagatgttttagcttaaaacctaaatgatgggttgataggtacagcaagccaccacagcatgtgtatacaacctgcatgttctgcacatgtatgtaacaaacctgcatgttctgcacgtgtgtttaacaaacctgcatgt

SEQ ID NO: 557 - protein, 26 aa, Homo sapiens
MCIQPACSAHVCNKPACSARVFNKPA

SEQ ID NO: 558 - DNA, 301 bp, Homo sapiens
tgattatatttgcaggaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacaggtaggcc

SEQ ID NO: 559 - protein, 97 aa, Homo sapiens
IIFAGSQPHTKPSVFVMKNGTNVACLVKEFYPKDIRINLVSSKKITEFDPAIVISPSGKYNAVKLGKYEDSNSVTCSVQHDNKTVHSTDFEVKTDST

SEQ ID NO: 560 - DNA, 775 bp, Homo sapiens
tgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagttaaaaaaaaaaaaaaaaaaaaaaaaaaaaa

SEQ ID NO: 561 - protein, 190 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 562 - DNA, 3202 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcgggtttggaaaggccccttggattcctggctggggacaatgatgacctggaccctggccagaagagccctggccctccagcaaggcagcacctgctctgatgcacctgtgcacccctggccctcccagccacctgggagcccgaagcttagcctgtaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagc

SEQ ID NO: 563 - protein, 569 aa, Homo sapiens
MRDNTSPISVILVSSGSRGNKLLFRYPFQRSQEHPASQTSKPRSRYAASNTGDHADEQDGDSRFSDVILATILATKSEMCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 564 - DNA, 1559 bp, Homo sapiens
cgcagggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgcgattgcctgacccaggcctgctcggccctcacaggcaaaggggtgcgcgagggcatcgagtggatggtgaagtgtgtcgtgcggaatgtgcaccggccgccgcggcagagggacatcacgtagcggcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtgaaaaaaaaaaaaaaaaaa

SEQ ID NO: 565 - protein, 201 aa, Homo sapiens
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 566 - DNA, 12563 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagcttatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggcacgcgggaatgtgaagggcgctccgggctctgagcccgcagcttttacgacttctccctgcgtcgttccttatattcacagaagccccatagtttcactgggttgcggttattttcctggtagtttgcgtgtaagaaagggagaatatagttttagaggaagctgaactatgacgatgctgggcgaacggtttgggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggaggccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgattttttttt

SEQ ID NO: 567 - protein, 2000 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWEL

SEQ ID NO: 568 - DNA, 3583 bp, Homo sapiens
aactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtggcccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 569 - protein, 535 aa, Homo sapiens
MFSWLGTDDRRRKDPEVFQTVSEGLKKLYKSKLLPLEEHYRFHEFHSPALEDADFDNKPMVLLVGQYSTGKTTFIRYLLEQDFPGMRIGPEPTTDSFIAVMQGDMEGIIPGNALVVDPKKPFRKLNAFGNAFLNRFVCAQLPNPVLESISVIDTPGILSGEKQRISRGYDFAAVLEWFAERVDRIILLFDAHKLDISDEFSEVIKALKNHEDKMRVVLNKADQIETQQLMRVYGALMWSLGKIVNTPEVIRVYIGSFWSHPLLIPDNRKLFEAEEQDLFRDIQSLPRNAALRKLNDLIKRARLAKVHAYIISSLKKEMPSVFGKDNKKKELVNNLAEIYGRIEREHQISPGDFPNLKRMQDQLQAQDFSKFQPLKSKLLEVVDDMLAHDIAQLMVLVRQEESQRPIQMVKGGAFEGTLHGPFGHGYGEGAGEGIDDAEWVVARDKPMYDEIFYTLSPVDGKITGANAKKEMVRSKLPNSVLGKIWKLADIDKDGMLDDDEFALANHLIKVKLEGHELPNELPAHLLPPSKRKVAE

SEQ ID NO: 570 - DNA, 1410 bp, Homo sapiens
cgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagaccaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaaaaaaaaaaaa

SEQ ID NO: 571 - protein, 204 aa, Homo sapiens
MAAAGWRDGSGQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 572 - DNA, 3306 bp, Homo sapiens
  Unsure 263,1605,1708-1750,1831,1851,1862,1883,1886,1889,3181: Unknown base
tttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcancttgccatgcagacctatgagatggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacgagacactgttttagtaaacatgctgagcattcattttgcgtcctctgggttggatgcgatgtgagaggatggcatgccagaattaggacacgacatgaaaccagagtggtgcctctgtccgagaacttggtctcactttgtcacccaggctggagcacagtggtgagatctcagctcactgcagccttgacctctgaagactcagtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacnccagaccttccagccctggcctgagaggctcagcaacaacgtggaagagctcctacaatcctccttgtccctgggaggccaggagcaagcgccagagcacaannnnnnnnnnnnnnnnnnnnnnnnnnnnnnnnnnnnnnnnnnnatgataatggagaacatccaggagctcattcgatcagcccaggaaatagatgaaatgaatgaaatatatgatgagaactcntactggagaaaccaaaaccntggcagcctcntgcagctgccccacacagagnccntgntggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgagcacccctgccctgcccctccttctcccagcaccccctcaatcagtcaccataactggtctattctgaggccccctctgcgagcagctaggatgtggaaagcggttcctgcttgcatctctggggcagaggcctccaccagcaggctctcctccattcctccagtcctggcggaagcaaggccctcctaggcagctggtggataacagaggagggtcctaagagcaccacaggaagaacccttggctgggccaggacttggacgttgaggtctcggtctgtctcctcttcttactcaccaagtagcctgggatgaggcacttccccctctgagcctcagccgcctgtttctgcatgaaaggggttgggctgcttgatgtctcctctggctttaaaaacccacatttgagtttcctccttccctctactgccctgtgcccatgcctgcccacctctcgttcttttgggcttctgacacctcccctcctccccactcctggcacctggctctgtgatacagaccgtctgcactgaatctgtgtgtaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttntgggtctgttactcggcccctactcacatttccttgggttggagcaacagtcccagagagggccatggtgggagctgcgccctccttaaaagatgactttacataaaatgttgatcttcagccaa

SEQ ID NO: 573 - protein, 248 aa, Homo sapiens
  Unsure 84: Unknown amino acid
MAAGMYLEHYLDSIENLPFELQRNFQLMRDLDQRTEDLKAEIDKLATEYMSSARSLSSEEKLALLKQIQEAYGKCKEFGDDKVXLAMQTYEMVDKHIRRLDTDLARFEADLKEKQIESSDYDSSSSKGKKSRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 574 - DNA, 491 bp, Homo sapiens
cccacagactcagagagaacccaccatggtgctgtctcctgacgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgcccctttgg

SEQ ID NO: 575 - protein, 142 aa, Homo sapiens [sequence omitted]

SEQ ID NO: 576 - DNA, 2932 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacaggagcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacct

SEQ ID NO: 577 - protein, 623 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRSFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGVRGARGGRGGNVGGKRKADGYNQPDSKRRQTNNQNWGSQPIAQQPLQGGDHSGNYGYKSENQEFYQDTFGQQWK

SEQ ID NO: 578 - DNA, 1582 bp, Homo sapiens
aattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccgcggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtgtttactctagtttataaaataatcttgtgaagtttgcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgttaagagaagaaaaactacctgtggtaggaattggaaagcatctgtgtggtatggcaacaggtacgtaaacatactgataatgtttacattaatgcattaagttttggcctaacctggccccaaccatttcagtggtctcttttgaatagatatcttatgtttacaactcaataatctttatagagcactggccctgtgctttattagatgcatagctttcctatttatctgctcatattggccattttgcaggatgaattaagagttttgtatgtaaatactgcatcacattagaccttaaagttctttgggttaaatttcaaccagaaaaggaaaataagaccatttatggaaactgtatgattccacctagaagctactgattttttagagtagttgcttagaaagaactcagaaacctcttctactaaaagactattgtgtttcaggattctggggaaaaagaaaaaaataaatgttagac

SEQ ID NO: 579 - protein, 175 aa, Homo sapiens
MATSATSPHAPGFPAEGRCGYYVEKKKRFCRMVVAAGKRFCGEHAGAAEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQVCLGYSNY

SEQ ID NO: 580 - DNA, 2553 bp, Homo sapiens
gcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaacatgtattttagagttcatctttggcaaaatctttggttcagggtactagttgtttaaaagttgattcatattcttaccttgtgctgagaaaggttgcattgctgccccttatacacatgctgcagcttgatgttaaagaatttttattctttctgaagaactaattaatgtttaaagcaactgtttaatatgatggcatgtgtgtgtgtgcgtgcgtgtgtatgttctgagtccacttcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtagtaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactttcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgtttaaaaaaatgatagaaatacattgttgatgggatatgagttaagtttattttctacaaactgtaattgatgaggacatggataatatcttcatgtttctgagaagtaatctgtatgtggggggaggggataataaatatttctacccccccaaaaaaaaaaaaaaaaaaaaaaaaaaaaaaaaaaaaa

SEQ ID NO: 581 - DNA, 584 bp, Homo sapiens
acactcgcttctggaacgtctgagattatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagcctcttgcccatgattcagagctttcaaggataggctttattctgcaagcaatacaaataataaatctattctgctgagagatcac

SEQ ID NO: 582 - protein, 147 aa, Homo sapiens
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTAVASALSSRYH

SEQ ID NO: 583 - DNA, 4064 bp, Homo sapiens
atgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcgaaaaaaaaaaaaaaaaaa

SEQ ID NO: 584 - protein, 1256 aa, Homo sapiens
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 585 - DNA, 792 bp, Homo sapiens
ccaagctccagctgtttgtcaaggcgagtgaggacggggagagcgtgggtcactgcccctcctgccagcggtcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcgggaaaaaaaaaaaaaaaaaaaaaaaaaaaaaaaaaaaaaaaaaaaaaaa

SEQ ID NO: 586 - protein, 207 aa, Homo sapiens
MVLLLKGVPFTLTTVDTRRSPDVLKDFAPGSQLPILLYDSDAKTDTLQIEDFLEETLGPPDFPSLAPRYRESNTAGNDVFHKFSAFIKNPVPAQDEALYQQLLRALARLDSYLRAPLEHELAGEPQLRESRRRFLDGDRLTLADCSLLPKLHIVDTVCAHFRQAPIPAELRGVRRYLDSAMQEKEFKYTCPHSAEILAAYRPAVHPR

SEQ ID NO: 587 - DNA, 14800 bp, Homo sapiens
cgcccgggcaggtggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcagggatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcgtggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacttggaggtggagcgctggcgggagcgggtcgcccaggtgcttgagcgctggcaggctgtgctggcccagaccgacttgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgagaccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaagagatcctggcgctgaaggcgagcttcgagaaggcggccgctggcaaggcggagctggagctggagctgggacgcatccgcagcaacgcggaggacacgctgcgcagcaaggagcaggccgagctggaggccgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaacgtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcaggcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccgagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctatgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaaaggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttttgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcgcccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 588 - protein, 2000 aa, Homo sapiens
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRDDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDLEVERWRERVAQVLERWQAVLAQTDLRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAETEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQR

SEQ ID NO: 589 - DNA, 5476 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagataataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgactttgactgaactccgggtccttcttgagcagatgggcagcctgccctgcgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccaacttctatctgtgtgtgtgggcaggtgccagctggggtgggacttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctttgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcgctgttgccgcagttgactggccctgtgttggagctgcctgaggcaatccgggctcccctggaggagctcatgatggaagggggcctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcctatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttgggaaaaaaaaaa

SEQ ID NO: 590 - protein, 1539 aa, Homo sapiens [sequence omitted]

SEQ ID NO: 591 - DNA, 584 bp, Homo sapiens; identical to SEQ ID NO: 581

SEQ ID NO: 592 - protein, 147 aa, Homo sapiens; identical to SEQ ID NO: 582

SEQ ID NO: 593 - DNA, 931 bp, Homo sapiens
cagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttaaaaaaaaaaaaaaaaaaaaaaaaaaaaaaaaaaaaaaaaaaaaaaaaaaaaaaaaaaaaaaaaaaaaaa

SEQ ID NO: 594 - protein, 263 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 595 - DNA, 4416 bp, Homo sapiens
ccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagttcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagttattgtgccttgttctaaaattttaagtagggcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacaattttgaacactgataggaaggtccacatccacaaagtttctcttgagttttgttatgtgttttgctgtgtttgattttcagtgattgtctggtatatttacagtcctcaaacatggttatttctgtcagtgacttaacattcggttttaccagccagcagtattcttcagtaaataaagaatggaattgctgaatgtaatcattgaacctcgagtcactgtaaaagttcagtaattgcttattgtattagttttagatgctggcaccgcatgtgctctgtttattctgattttactaaaataaaaagttcaaaagtcaaaaaaaaaa

SEQ ID NO: 596 - protein, 660 aa, Homo sapiens
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

---

What is claimed:

1. A method of diagnosing Systemic Lupus Erythematosis (SLE) in a mammal, said method comprising detecting the level of expression of a gene encoding a PRO polypeptide of SEQ ID NO:319,
   (a) in a test sample of blood cells obtained from the mammal, and
   (b) in a control sample of known normal blood cells, wherein a higher level of expression of said gene in the test sample as compared to the control sample is indicative of the presence of SLE in the mammal from which the test blood cells were obtained.

2. The method of claim 1, wherein said blood cells are Peripheral Blood Mononuclear Cells (PBMC).

3. The method of claim 1 or 2 wherein the level of expression is determined by hybridization of nucleic acid obtained from the test and normal blood cell samples to one or more probes specific for the nucleic acid encoding a PRO polypeptide of SEQ ID NO:319.

4. The method of claim 3 wherein hybridization is performed under stringent conditions, wherein said stringent conditions use 50% formamide, 5×SSC, 50 mM sodium phosphate (pH 6.8), 0.1% sodium pyrophosphate, 5× Denhardt's solution, sonicated salmon sperm DNA (50 µg/ml.), 0.1% SDS, and 10% dextran sulfate at 42° C.

5. The method of claim 4 wherein the nucleic acids obtained from the test and normal blood cell samples are cDNAs.

6. The method of claim 5 wherein the nucleic acids obtained from the test and normal blood cell samples are placed on microarrays.

7. The method of claim 1, wherein said mammal is human.

* * * * *